US012576151B2

(12) United States Patent
Gehrke

(10) Patent No.: US 12,576,151 B2
(45) Date of Patent: Mar. 17, 2026

(54) FRATRICIDE RESISTANT MODIFIED IMMUNE CELLS AND METHODS OF USING THE SAME

(71) Applicant: Beam Therapeutics Inc., Cambridge, MA (US)

(72) Inventor: Jason Gehrke, Cambridge, MA (US)

(73) Assignee: Beam Therapeutics Inc., Cambridge, MA (US)

( * ) Notice: Subject to any disclaimer, the term of this patent is extended or adjusted under 35 U.S.C. 154(b) by 539 days.

(21) Appl. No.: 18/246,656

(22) PCT Filed: Sep. 24, 2021

(86) PCT No.: PCT/US2021/052035

§ 371 (c)(1),
(2) Date: Mar. 24, 2023

(87) PCT Pub. No.: WO2022/067089

PCT Pub. Date: Mar. 31, 2022

(65) Prior Publication Data

US 2025/0262304 A1 Aug. 21, 2025

Related U.S. Application Data

(60) Provisional application No. 63/083,540, filed on Sep. 25, 2020.

(51) Int. Cl.

| | |
|---|---|
| ***A61K 40/42*** | (2025.01) |
| ***A61K 40/11*** | (2025.01) |
| ***A61K 40/22*** | (2025.01) |
| ***A61K 40/31*** | (2025.01) |
| ***A61P 35/02*** | (2006.01) |
| ***C07K 14/725*** | (2006.01) |
| ***C07K 16/28*** | (2006.01) |
| ***C12N 5/0783*** | (2010.01) |
| ***C12N 15/90*** | (2006.01) |

(52) U.S. Cl.

CPC .......... *A61K 40/4224* (2025.01); *A61K 40/11* (2025.01); *A61K 40/22* (2025.01); *A61K 40/31* (2025.01); *A61K 40/421* (2025.01); *A61P 35/02* (2018.01); *C07K 14/7051* (2013.01); *C07K 16/2806* (2013.01); *C12N 5/0636* (2013.01); *C12N 5/0646* (2013.01); *C12N 15/907* (2013.01); *A61K 2239/28* (2023.05); *A61K 2239/48* (2023.05); *C07K 2317/622* (2013.01)

(58) Field of Classification Search

CPC ................................................. A61K 40/4224

See application file for complete search history.

(56) References Cited

U.S. PATENT DOCUMENTS

| | | | |
|---|---|---|---|
| 7,915,114 | B2 | 3/2011 | Hsiao et al. |
| 9,068,179 | B1 | 6/2015 | Liu et al. |
| 9,322,037 | B2 | 4/2016 | Liu et al. |
| 9,388,430 | B2 | 7/2016 | Liu et al. |
| 9,512,446 | B1 | 12/2016 | Joung et al. |
| 9,737,604 | B2 | 8/2017 | Liu et al. |
| 9,783,591 | B2 | 10/2017 | June et al. |
| 9,840,699 | B2 | 12/2017 | Liu et al. |
| 10,113,163 | B2 | 10/2018 | Liu et al. |
| 10,167,457 | B2 | 1/2019 | Liu et al. |
| 10,465,176 | B2 | 11/2019 | Liu et al. |
| 10,501,519 | B2 | 12/2019 | June et al. |
| 10,526,401 | B2 | 1/2020 | Muir et al. |
| 10,682,410 | B2 | 6/2020 | Liu et al. |
| 10,745,677 | B2 | 8/2020 | Maianti et al. |
| 10,912,833 | B2 | 2/2021 | Liu et al. |
| 10,947,530 | B2 | 3/2021 | Liu et al. |
| 10,968,426 | B2 | 4/2021 | Meissner et al. |
| 11,053,481 | B2 | 7/2021 | Liu et al. |
| 11,090,336 | B2 | 8/2021 | Posey et al. |
| 11,124,782 | B2 | 9/2021 | Liu et al. |
| 11,142,550 | B2 | 10/2021 | Muir et al. |
| 11,142,760 | B2 | 10/2021 | Slaymaker et al. |
| 11,155,803 | B2 | 10/2021 | Gaudelli et al. |
| 11,193,123 | B2 | 12/2021 | Halperin |
| 11,214,780 | B2 | 1/2022 | Liu et al. |
| 11,268,082 | B2 | 3/2022 | Liu et al. |
| 11,306,324 | B2 | 4/2022 | Liu et al. |
| 11,319,532 | B2 | 5/2022 | Liu et al. |
| 11,344,609 | B2 | 5/2022 | Slaymaker et al. |
| 11,479,767 | B2 | 10/2022 | Smith et al. |
| 11,542,496 | B2 | 1/2023 | Liu et al. |
| 11,702,651 | B2 | 7/2023 | Liu et al. |
| 11,732,274 | B2 | 8/2023 | Liu et al. |

(Continued)

FOREIGN PATENT DOCUMENTS

| | | |
|---|---|---|
| CN | 103088008 A | 5/2013 |
| CN | 105934516 A | 9/2016 |

(Continued)

OTHER PUBLICATIONS

Mullins et al., "Transgenesis in Nonmurine Species," Hypertension, Oct. 1993, vol. 22, No. 4, pp. 630-633.

(Continued)

*Primary Examiner* — Prema M Mertz

(74) *Attorney, Agent, or Firm* — Greenberg Traurig, LLP; Melissa Hunter-Ensor; Nicholas R. Ballor

(57) ABSTRACT

The present invention features fratricide resistant modified immune cells (e.g., T- or NK-cells) having enhanced anti-neoplasia activity and methods for producing and using the same. Methods of treating neoplasia (e.g., T- or NK-cell malignancies) using fratricide resistant modified immune cells are also provided.

8 Claims, 29 Drawing Sheets

Specification includes a Sequence Listing.

(56) References Cited

U.S. PATENT DOCUMENTS

| | | | |
|---|---|---|---|
| 11,866,727 | B2 | 1/2024 | Cowan et al. |
| 12,129,478 | B1 | 10/2024 | Chen et al. |
| 2004/0003420 | A1 | 1/2004 | Kuhn et al. |
| 2004/0115184 | A1 | 6/2004 | Smith et al. |
| 2005/0222030 | A1 | 10/2005 | Allison |
| 2011/0104787 | A1 | 5/2011 | Church et al. |
| 2013/0109048 | A1 | 5/2013 | Giugliano et al. |
| 2014/0068797 | A1 | 3/2014 | Doudna et al. |
| 2014/0186958 | A1 | 7/2014 | Zhang et al. |
| 2014/0273226 | A1 | 9/2014 | Wu |
| 2014/0273230 | A1 | 9/2014 | Chen et al. |
| 2014/0356956 | A1 | 12/2014 | Church et al. |
| 2014/0370045 | A1 | 12/2014 | June et al. |
| 2015/0071903 | A1 | 3/2015 | Liu et al. |
| 2015/0165054 | A1 | 6/2015 | Liu et al. |
| 2015/0166980 | A1 | 6/2015 | Liu et al. |
| 2015/0166982 | A1 | 6/2015 | Liu et al. |
| 2015/0166984 | A1 | 6/2015 | Liu et al. |
| 2015/0166985 | A1 | 6/2015 | Liu et al. |
| 2015/0344549 | A1 | 12/2015 | Muir et al. |
| 2016/0046961 | A1 | 2/2016 | Jinek et al. |
| 2016/0200779 | A1 | 7/2016 | Liu et al. |
| 2016/0201089 | A1 | 7/2016 | Gersbach et al. |
| 2016/0208243 | A1 | 7/2016 | Zhang et al. |
| 2016/0280798 | A1 | 9/2016 | Orentas et al. |
| 2016/0304846 | A1 | 10/2016 | Liu et al. |
| 2017/0020922 | A1 | 1/2017 | Wagner et al. |
| 2017/0121693 | A1 | 5/2017 | Liu et al. |
| 2017/0209492 | A1 | 7/2017 | June et al. |
| 2017/0233703 | A1 | 8/2017 | Xie et al. |
| 2017/0275648 | A1 | 9/2017 | Barrangou et al. |
| 2017/0327804 | A9 | 11/2017 | Joung et al. |
| 2018/0037625 | A1 | 2/2018 | June et al. |
| 2018/0073012 | A1 | 3/2018 | Liu et al. |
| 2018/0118834 | A1 | 5/2018 | Brogdon et al. |
| 2018/0127780 | A1 | 5/2018 | Liu et al. |
| 2018/0171298 | A1 | 6/2018 | Duchateau et al. |
| 2018/0179503 | A1 | 6/2018 | Maianti et al. |
| 2018/0216095 | A1 | 8/2018 | Thanos et al. |
| 2018/0237787 | A1 | 8/2018 | Maianti et al. |
| 2018/0273601 | A1 | 9/2018 | Adusumilli et al. |
| 2018/0298421 | A1 | 10/2018 | Carpenter et al. |
| 2018/0312825 | A1 | 11/2018 | Liu et al. |
| 2018/0312828 | A1 | 11/2018 | Liu et al. |
| 2018/0312848 | A1 | 11/2018 | Zhao et al. |
| 2018/0320163 | A1 | 11/2018 | Koonin et al. |
| 2019/0002875 | A1 | 1/2019 | Cheng et al. |
| 2019/0010471 | A1 | 1/2019 | Zhang et al. |
| 2019/0010481 | A1 | 1/2019 | Joung et al. |
| 2019/0093099 | A1 | 3/2019 | Liu et al. |
| 2019/0183932 | A1 | 6/2019 | MacKall et al. |
| 2019/0225955 | A1 | 7/2019 | Liu et al. |
| 2019/0345217 | A1 | 11/2019 | Ma et al. |
| 2019/0352369 | A1 | 11/2019 | June et al. |
| 2019/0352370 | A1 | 11/2019 | Bachmann et al. |
| 2019/0367891 | A1 | 12/2019 | Liu et al. |
| 2019/0389928 | A1 | 12/2019 | Posey et al. |
| 2020/0000937 | A1 | 1/2020 | DiPersio et al. |
| 2020/0063127 | A1 | 2/2020 | Lu et al. |
| 2020/0190493 | A1 | 6/2020 | Liu et al. |
| 2020/0306304 | A1 | 10/2020 | Posey et al. |
| 2020/0308571 | A1 | 10/2020 | Joung et al. |
| 2020/0370013 | A1 | 11/2020 | Posey et al. |
| 2020/0399619 | A1 | 12/2020 | Maianti et al. |
| 2021/0032363 | A1 | 2/2021 | Lynn et al. |
| 2021/0032661 | A1 | 2/2021 | Powell et al. |
| 2021/0060071 | A1 | 3/2021 | Posey et al. |
| 2021/0137979 | A1 | 5/2021 | Monje-Deisseroth et al. |
| 2021/0171602 | A1 | 6/2021 | MacKall et al. |
| 2021/0230246 | A1 | 7/2021 | Posey et al. |
| 2021/0252118 | A1 | 8/2021 | Slaymaker et al. |
| 2021/0371858 | A1 | 12/2021 | Evans et al. |
| 2021/0380955 | A1 | 12/2021 | Bryson et al. |
| 2022/0047637 | A1 | 2/2022 | Lamothe-Dreuzy et al. |
| 2022/0098572 | A1 | 3/2022 | Slaymaker et al. |
| 2022/0119785 | A1 | 4/2022 | Liu et al. |
| 2022/0127594 | A1 | 4/2022 | Gaudelli et al. |
| 2022/0133790 | A1 | 5/2022 | Gehrke et al. |
| 2022/0136012 | A1 | 5/2022 | Gaudelli et al. |
| 2022/0169998 | A1 | 6/2022 | Joung et al. |
| 2022/0170027 | A1 | 6/2022 | Gaudelli et al. |
| 2022/0220462 | A1 | 7/2022 | Liu et al. |
| 2022/0290115 | A1 | 9/2022 | Liu et al. |
| 2022/0290134 | A1 | 9/2022 | Jin et al. |
| 2022/0290164 | A1 | 9/2022 | Ran et al. |
| 2022/0307003 | A1 | 9/2022 | Liu |
| 2022/0387622 | A1 | 12/2022 | Gehrke et al. |
| 2023/0021636 | A1 | 1/2023 | Gehrke et al. |
| 2023/0075877 | A1 | 3/2023 | Gaudelli et al. |
| 2023/0080198 | A1 | 3/2023 | Gaudelli et al. |
| 2023/0101597 | A1 | 3/2023 | Gaudelli et al. |
| 2023/0108687 | A1 | 4/2023 | Liu et al. |
| 2023/0140953 | A1 | 5/2023 | Slaymaker et al. |
| 2023/0159956 | A1 | 5/2023 | Bryson et al. |
| 2023/0212575 | A1 | 7/2023 | Odate et al. |
| 2023/0348883 | A1 | 11/2023 | Liu et al. |
| 2023/0383277 | A1 | 11/2023 | Cafferty et al. |
| 2023/0407277 | A1 | 12/2023 | Joung et al. |
| 2024/0132867 | A1 | 4/2024 | Gaudelli et al. |
| 2024/0287453 | A1 | 8/2024 | Maldini et al. |
| 2024/0325533 | A1 | 10/2024 | Murray et al. |

FOREIGN PATENT DOCUMENTS

| | | | |
|---|---|---|---|
| CN | 106061510 | A | 10/2016 |
| CN | 106103475 | A | 11/2016 |
| CN | 106916852 | A | 7/2017 |
| CN | 107043779 | A | 8/2017 |
| CN | 107075483 | A | 8/2017 |
| CN | 107109413 | A | 8/2017 |
| CN | 107206024 | A | 9/2017 |
| CN | 107249606 | A | 10/2017 |
| CN | 107532161 | A | 1/2018 |
| CN | 108064282 | A | 5/2018 |
| CN | 108290933 | A | 7/2018 |
| CN | 108513575 | A | 9/2018 |
| CN | 108699116 | A | 10/2018 |
| CN | 108753823 | A | 11/2018 |
| CN | 108949825 | A | 12/2018 |
| CN | 109295186 | A | 2/2019 |
| CN | 109328231 | A | 2/2019 |
| CN | 109706121 | A | 5/2019 |
| CN | 109957569 | A | 7/2019 |
| CN | 109996811 | A | 7/2019 |
| CN | 110214180 | A | 9/2019 |
| CN | 110214183 | A | 9/2019 |
| CN | 110268050 | A | 9/2019 |
| EP | 2877490 | B1 | 9/2018 |
| EP | 3956349 | A1 | 2/2022 |
| JP | 2017500035 | A | 1/2017 |
| JP | 2017508468 | A | 3/2017 |
| JP | 2018500006 | A | 1/2018 |
| JP | 2018536436 | A | 12/2018 |
| JP | 6629734 | B2 | 1/2020 |
| KR | 20160050069 | A | 5/2016 |
| WO | 1997025416 | A2 | 7/1997 |
| WO | 2001038547 | A2 | 5/2001 |
| WO | 2002068676 | A2 | 9/2002 |
| WO | 2002103028 | A2 | 12/2002 |
| WO | 2010132092 | A2 | 11/2010 |
| WO | 2011075627 | A1 | 6/2011 |
| WO | 2013045632 | A1 | 4/2013 |
| WO | 2013126729 | A1 | 8/2013 |
| WO | 2013176772 | A1 | 11/2013 |
| WO | 2013188037 | A2 | 12/2013 |
| WO | 2014004336 | A2 | 1/2014 |
| WO | 2014089290 | A1 | 6/2014 |
| WO | 2014184143 | A1 | 11/2014 |
| WO | 2014184741 | A1 | 11/2014 |
| WO | 2014186686 | A2 | 11/2014 |
| WO | 2015006294 | A2 | 1/2015 |
| WO | 2015006498 | A2 | 1/2015 |
| WO | 2015021426 | A1 | 2/2015 |
| WO | 2015069922 | A2 | 5/2015 |

(56) References Cited

FOREIGN PATENT DOCUMENTS

| | | | |
|---|---|---|---|
| WO | 2015089277 | A1 | 6/2015 |
| WO | 2015089406 | A1 | 6/2015 |
| WO | 2015090230 | A1 | 6/2015 |
| WO | 2015092024 | A2 | 6/2015 |
| WO | 2015133554 | A1 | 9/2015 |
| WO | 2015142675 | A2 | 9/2015 |
| WO | 2015191693 | A2 | 12/2015 |
| WO | 2016011210 | A2 | 1/2016 |
| WO | 2016016343 | A1 | 2/2016 |
| WO | 2016019300 | A1 | 2/2016 |
| WO | 2016061368 | A1 | 4/2016 |
| WO | 2016069910 | A1 | 5/2016 |
| WO | 2016072399 | A1 | 5/2016 |
| WO | 2016073649 | A1 | 5/2016 |
| WO | 2016075612 | A1 | 5/2016 |
| WO | 2016094304 | A2 | 6/2016 |
| WO | 2016115482 | A1 | 7/2016 |
| WO | 2016138038 | A1 | 9/2016 |
| WO | 2016142532 | A2 | 9/2016 |
| WO | 2016160721 | A1 | 10/2016 |
| WO | 2016172727 | A1 | 10/2016 |
| WO | 2016183438 | A1 | 11/2016 |
| WO | 2016196308 | A1 | 12/2016 |
| WO | 2016196388 | A1 | 12/2016 |
| WO | 2016205711 | A1 | 12/2016 |
| WO | 2016205759 | A1 | 12/2016 |
| WO | 2017011721 | A1 | 1/2017 |
| WO | 2017048969 | A1 | 3/2017 |
| WO | 2017049166 | A1 | 3/2017 |
| WO | 2017070632 | A2 | 4/2017 |
| WO | 2017070633 | A2 | 4/2017 |
| WO | 2017077386 | A1 | 5/2017 |
| WO | 2017079703 | A1 | 5/2017 |
| WO | 2017079705 | A1 | 5/2017 |
| WO | 2017093804 | A2 | 6/2017 |
| WO | 2017132580 | A2 | 8/2017 |
| WO | 2017152015 | A1 | 9/2017 |
| WO | 2017165862 | A1 | 9/2017 |
| WO | 2017173054 | A1 | 10/2017 |
| WO | 2017180993 | A1 | 10/2017 |
| WO | 2017184768 | A1 | 10/2017 |
| WO | 2017189308 | A1 | 11/2017 |
| WO | 2018009562 | A1 | 1/2018 |
| WO | 2018020323 | A2 | 2/2018 |
| WO | 2018027036 | A1 | 2/2018 |
| WO | 2018027078 | A1 | 2/2018 |
| WO | 2018035388 | A1 | 2/2018 |
| WO | 2018041973 | A1 | 3/2018 |
| WO | 2018071868 | A1 | 4/2018 |
| WO | 2018085690 | A1 | 5/2018 |
| WO | 2018089664 | A1 | 5/2018 |
| WO | 2018119354 | A1 | 6/2018 |
| WO | 2018119359 | A1 | 6/2018 |
| WO | 2018129129 | A1 | 7/2018 |
| WO | 2018140725 | A1 | 8/2018 |
| WO | 2018160768 | A1 | 9/2018 |
| WO | 2018165629 | A1 | 9/2018 |
| WO | 2018165631 | A1 | 9/2018 |
| WO | 2018176009 | A1 | 9/2018 |
| WO | 2018183888 | A2 | 10/2018 |
| WO | 2018204427 | A1 | 11/2018 |
| WO | 2018213708 | A1 | 11/2018 |
| WO | 2018213726 | A1 | 11/2018 |
| WO | 2018218188 | A2 | 11/2018 |
| WO | 2018231871 | A1 | 12/2018 |
| WO | 2019005884 | A1 | 1/2019 |
| WO | 2019005886 | A1 | 1/2019 |
| WO | 2019014456 | A1 | 1/2019 |
| WO | 2019023680 | A1 | 1/2019 |
| WO | 2019040650 | A1 | 2/2019 |
| WO | 2019071274 | A1 | 4/2019 |
| WO | 2019079347 | A1 | 4/2019 |
| WO | 2019118902 | A2 | 6/2019 |
| WO | 2019120310 | A1 | 6/2019 |
| WO | 2019139645 | A2 | 7/2019 |
| WO | 2019161271 | A1 | 8/2019 |
| WO | 2019183000 | A1 | 9/2019 |
| WO | 2019199689 | A1 | 10/2019 |
| WO | 2019210207 | A2 | 10/2019 |
| WO | 2019217941 | A1 | 11/2019 |
| WO | 2019217942 | A1 | 11/2019 |
| WO | 2019217943 | A1 | 11/2019 |
| WO | 2019217944 | A1 | 11/2019 |
| WO | 2019226953 | A1 | 11/2019 |
| WO | 2020010239 | A1 | 1/2020 |
| WO | 2020028823 | A1 | 2/2020 |
| WO | 2020041751 | A1 | 2/2020 |
| WO | 2020051561 | A1 | 3/2020 |
| WO | 2020/132327 | A1 | 6/2020 |
| WO | 2020112870 | A1 | 6/2020 |
| WO | 2020118076 | A1 | 6/2020 |
| WO | 2020/150534 | A2 | 7/2020 |
| WO | 2020160514 | A1 | 8/2020 |
| WO | 2020160517 | A1 | 8/2020 |
| WO | 2020163396 | A1 | 8/2020 |
| WO | 2020168051 | A1 | 8/2020 |
| WO | 2020168075 | A1 | 8/2020 |
| WO | 2020168088 | A1 | 8/2020 |
| WO | 2020168122 | A1 | 8/2020 |
| WO | 2020168132 | A1 | 8/2020 |
| WO | 2020168133 | A1 | 8/2020 |
| WO | 2020168135 | A1 | 8/2020 |
| WO | 2020168300 | A1 | 8/2020 |
| WO | 2020176897 | A1 | 9/2020 |
| WO | 2020198413 | A1 | 10/2020 |
| WO | 2020214842 | A1 | 10/2020 |
| WO | 2020227446 | A1 | 11/2020 |
| WO | 2020227447 | A1 | 11/2020 |
| WO | 2020236936 | A1 | 11/2020 |
| WO | 2020236964 | A1 | 11/2020 |
| WO | 2020236982 | A1 | 11/2020 |
| WO | 2021020884 | A2 | 2/2021 |
| WO | 2021022043 | A2 | 2/2021 |
| WO | 2021041945 | A2 | 3/2021 |
| WO | 2021042062 | A2 | 3/2021 |
| WO | 2021050571 | A1 | 3/2021 |
| WO | 2021055459 | A1 | 3/2021 |
| WO | 2021062227 | A2 | 4/2021 |
| WO | 2021072250 | A1 | 4/2021 |
| WO | 2021081264 | A1 | 4/2021 |
| WO | 2021087182 | A1 | 5/2021 |
| WO | 2021087356 | A1 | 5/2021 |
| WO | 2021097521 | A1 | 5/2021 |
| WO | 2021108717 | A2 | 6/2021 |
| WO | 2021127594 | A1 | 6/2021 |
| WO | 2021158921 | A2 | 8/2021 |
| WO | 2021163616 | A1 | 8/2021 |
| WO | 2021175288 | A1 | 9/2021 |
| WO | 2021207651 | A2 | 10/2021 |
| WO | 2022008935 | A1 | 1/2022 |
| WO | 2022015969 | A1 | 1/2022 |
| WO | 2022056254 | A2 | 3/2022 |
| WO | 2022056324 | A1 | 3/2022 |
| WO | 2022067089 | A1 | 3/2022 |
| WO | 2022081890 | A1 | 4/2022 |
| WO | 2022112404 | A1 | 6/2022 |
| WO | 2022148955 | A1 | 7/2022 |
| WO | 2022150367 | A1 | 7/2022 |
| WO | 2022150372 | A1 | 7/2022 |
| WO | 2022150706 | A2 | 7/2022 |
| WO | 2022204574 | A1 | 9/2022 |
| WO | 2022272292 | A2 | 12/2022 |
| WO | 2023279118 | A2 | 1/2023 |
| WO | 2023288304 | A2 | 1/2023 |
| WO | 2023023515 | A1 | 2/2023 |
| WO | 2023034959 | A2 | 3/2023 |
| WO | 2023047338 | A1 | 3/2023 |
| WO | 2023049299 | A2 | 3/2023 |
| WO | 2023108107 | A2 | 6/2023 |
| WO | 2023125814 | A1 | 7/2023 |
| WO | 2023155901 | A1 | 8/2023 |
| WO | 2023193536 | A1 | 10/2023 |
| WO | 2023227669 | A2 | 11/2023 |
| WO | 2023235813 | A2 | 12/2023 |

(56) References Cited

FOREIGN PATENT DOCUMENTS

| | | | |
|---|---|---|---|
| WO | 2023247753 | A1 | 12/2023 |
| WO | 2023248110 | A1 | 12/2023 |
| WO | 2024006772 | A2 | 1/2024 |
| WO | 2024040083 | A1 | 2/2024 |
| WO | 2024063273 | A1 | 3/2024 |
| WO | 2024073385 | A2 | 6/2024 |
| WO | 2024179426 | A2 | 9/2024 |
| WO | 2024226156 | A1 | 10/2024 |
| WO | 2024227047 | A2 | 10/2024 |
| WO | 2024259364 | A2 | 12/2024 |

OTHER PUBLICATIONS

Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.
Musallam et al., "Fetal hemoglobin levels and morbidity in untransfused patients with β-thalassemia intermedia," Blood, Jan. 12, 2012, vol. 119, No. 2, pp. 364-367.
Navaratnam et al., "An Overview of Cytidine Deaminases," International Journal of Hematology, 2006, vol. 83, pp. 195-200.
NCBI Reference Sequence No. NC_000001.11, downloaded Jan. 9, 2024.
NCBI Reference Sequence No. NP_000286.3, downloaded Sep. 27, 2023.
NCBI Reference Protein No. Q694B3.2, downloaded Apr. 8, 2024.
NCBI Reference Sequence No. WP_001297409.1, downloaded Aug. 14, 2023.
NCBI Reference Sequence No. WP_002989955.1, downloaded Jan. 9, 2024.
NCBI Reference Sequence No. WP_010922251.1, downloaded Jan. 9, 2024.
NCBI Reference Sequence No. WP_011054416.1, downloaded Jan. 9, 2024.
NCBI Reference Sequence No. WP_011284745.1, downloaded Jan. 9, 2024.
NCBI Reference Sequence No. WP_011285506.1, downloaded Jan. 9, 2024.
NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032188360.1, downloaded Apr. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.
Nelson et al., "In vivo genome editing improves muscle function in a mouse model of Duchenne muscular dystrophy," Science, Jan. 22, 2016, vol. 351, No. 6271, pp. 403-407.
Newby et al. "Base editing of haematopoietic stem cells rescues sickle cell disease in mice", Nature, Nature Publishing Group UK, London, 2021, vol. 595, Article No. 7866, pp. 295-302, p. 296; Figure 1, p. 301.
Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.
Nishida et al., "Targeted nucleotide editing using hybrid prokaryotic and vertebrate adaptive immune systems," Science, Sep. 16, 2016, vol. 353, No. 6305, pp. 1248-aaf8729-8.
Nishimasu et al., "Engineered CRISPR-Cas9 nuclease with expanded targeting space," Science, Sep. 21, 2018, vol. 361, pp. 1259-1262.
O'Connell et al., Programmable RNA recognition and cleavage by CRISPR/Cas9. Nature, 2014, vol. 516, p. 263-266.
Okumura et al., "Evolutionary paths of streptococcal and staphylococcal superantigens," BMC Genomics, 2012, vol. 13, No. 404, pp. 1-16.
Ousterout et al., "Multiplex CRISPR/Cas9-based genome editing for correction of dystrophin mutations that cause Duchenne muscular dystrophy," Nature Communications, Feb. 2015, vol. 6, No. 6244, pp. 1-13.
Parr et al., "N1-Methylpseudouridine substitution enhances the performance of synthetic mRNA switches in cells," Nucleic Acids Research, 2020, vol. 48, No. 6, e35, pp. 1-9.
Pattanayak et al., "High-throughput profiling of off-target DNA cleavage reveals RNA-programmed Cas9 nuclease specificity," Nature Biotechnology, Sep. 2013, vol. 31, No. 9, pp. 839-843.
Pausch et al., "CRISPR-Casϕ from huge phages is a hypercompact genome editor," Science, Jul. 17, 2020, vol. 369, pp. 333-337.
Phillips, Anthony J., "The challenge of gene therapy and DNA delivery," Journal of Pharmacy and Pharmacology, 2001, vol. 53, pp. 1169-1174.
Plosky, Brian S., "CRISPR-Mediated Base Editing without DNA Double-Strand Breaks," Molecular Cell, May 19, 2016, vol. 62, pp. 477-478.
Poirot et al., "Multiplex Genome-Edited T-cell Manufacturing Platform for "Off-the-Shelf" Adoptive T-cell Immunotherapies," Cancer Research, Sep. 15, 2015, vol. 75, No. 18. pp. 3853-3864.
Poller et al., "A Leucine-to-Proline Substitution Causes a Defective α1-Antichymotrypsin Allele Associated with Familial Obstructive Lung Disease," Genomics, 1993, vol. 17, pp. 740-743.
Pournasr et al., "Modeling Inborn Errors of Hepatic Metabolism Using Induced Pluripotent Stem Cells," Arteriosclerosis, Thrombosis, and Vascular Biology, Nov. 2017, vol. 37, pp. 1994-1999.
Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.
UniProt Accession No. P51908, Downloaded Jan. 9, 2024.
UniProt Accession No. Q6JC40, Downloaded Nov. 14, 2024.
UniProt Accession No. Q99ZW2, Downloaded Oct. 18, 2023.
UniProt Proteome ID No. UP000009215, downloaded Aug. 14, 2023.
Valdmanis et al., "Future of rAAV Gene Therapy: Platform for RNAi, Gene Editing, and Beyond," Human Gene Therapy, 2017, vol. 28, No. 4, pp. 361-372.
Wacey et al., "Disentangling the perturbational effects of amino acid substitutions in the DNA-binding domain of p53," Human Genetics, 1999, vol. 104, pp. 15-22.

(56) References Cited

OTHER PUBLICATIONS

Walton et al., "Unconstrained genome targeting with near-PAMless engineered CRISPR-Cas9 variants," Science, Mar. 26, 2020, pp. 1-7 and pp. 8-11 containing Figures (11 total pages).
Wan et al. "Material solutions for delivery of CRISPR/Cas-based genome editing tools: current status and future outlook." Materials Today, Jun. 2019, vol. 26, pp. 40-66.
Wang et al., "Enhanced base editing by co-expression of free uracil DNA glycosylase inhibitor," Cell research, Oct. 2017, vol. 27, No. 10, pp. 1289-1292.
Wang et al., "Eliminating base-editor-induced genome-wide and transcriptome-wide off-target mutations," Nature Cell Biology, May 2021, vol. 23, pp. 552-563 and p. 564-.583 containing Methods, Figures and Reporting Summary (32 total pages).
Webber et al., "Multiplex Human T Cell Engineering without Double-Strand Break Induction Using the Cas9 Base Editor System," Blood, Nov. 29, 2018, vol. 132, Article No. Suppl. 1, p. 3495.
Webber et al., "Highly efficient multiplex human T cell engineering without double-strand breaks using Cas9 base editors," Nature Communications, 2019, vol. 10, No. 5222, pp. 1-10.
Wei et al., "The "new favorite" of gene editing technology-single base editors," Hereditas, 2017, vol. 39, No. 12, pp. 1115-1121 [English Abstract].
Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.
Wienert et al., "KLF1 drives the expression of fetal hemoglobin in British HPFH," Blood, Aug. 10, 2017, vol. 130, No. 6, pp. 803-807.
Wijesinghe et al., "Efficient deamination of 5-methylcytosines in DNA by human APOBEC3A, but not by AID or APOBEC3G," Nucleic Acids Research, 2012, vol. 40, No. 18, pp. 9206-9217.
Wirth et al., "Mildly affected patients with spinal muscular atrophy are partially protected by an increased SMN2 copy number," Human Genetics, 2006, vol. 119, pp. 422-428.
Wolf et al., "tadA, an essential tRNA-specific adenosine deaminase from *Escherichia coli*," The EMBO Journal, 2002, vol. 21, No. 14, pp. 3841-3851.
Xu et al., "Mechanisms of Relapse After CD19 CAR T-Cell Therapy for Acute Lymphoblastic Leukemia and Its Prevention and Treatment Strategies," Frontiers in Immunology, Nov. 2019, vol. 10, No. 2664, pp. 1-15.
Yan et al., "Functionally diverse type V CRISPR-Cas systems," Science, Jan. 4, 2019, vol. 363, pp. 88-91.
Yan et al., "High-efficiency and multiplex adenine base editing in plants using new TadA variants," Molecular Plant, May 3, 2021, vol. 14, pp. 722-731.
Yang et al., "APOBEC: From mutator to editor," Journal of Genetics and Genomics, 2017, vol. 44, pp. 423-437.
Yang et al., "Increasing targeting scope of adenosine base editors in mouse and rat embryos through fusion of TadA deaminase with Cas9 variants," Protein & Cell, 2018, vol. 9, No. 9, pp. 814-819.
Yang et al., "PAM-Dependent Target DNA Recognition and Cleavage by C2c1 CRISPR-Cas Endonuclease," Cell, Dec. 15, 2016, vol. 167, pp. 1814-1828 and pp. e1-e12 containing Star Methods and Supplemental Figures (28 total pages).
Yang et al., "Engineering and optimising deaminase fusions for genome editing," Nature Communications, 2016, vol. 7, No. 13330, pp. 1-11 and p. 12 containing Corrigendum (12 total pages).
Yeh et al., "In vivo base editing of post-mitotic sensory cells," Nature Communications, 2018, vol. 9, No. 2184, pp. 1-10.
Yong et al., "Base Editing and its Applications in Gene Therapy," Chinese Journal of Otology, 2018, vol. 16, No. 2, pp. 150-154 [English Abstract].
Yu et al., "Cutting Edge: Single-Chain Trimers of MHC Class I Molecules Form Stable Structures That Potently Stimulate Antigen-Specific T Cells and B Cells," The Journal of Immunology, 2002, vol. 168, pp. 3145-3149.
Yu et al., "Cytosine base editors with minimized unguided DNA and RNA off-target events and high on-target activity," Nature Communications, 2020, vol. 11, No. 2052, pp. 1-10.
Yuliang et al., "Diagnosis and treatment of a1-antitrypsin deficiency," Practical Clinical Medicine, 2017, vol. 2, pp. 104-107 [English Abstract Only].
Zafra et al., "Optimized base editors enable efficient editing in cells, organoids and mice," Nature Biotechnology, Oct. 2018, vol. 36, Article No. 9, pp. 888-893 and pp. 15-20 containing Figures (20 total pages).
Zhang et al., "Genetic abrogation of immune checkpoints in antigen-specific cytotoxic T-lymphocyte as a potential alternative to blockade immunotherapy," Scientific Reports, 2018, vol. 8, No. 5549, pp. 1-13.
Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].
Zheng et al., "DNA Editing in DNA/RNA Hybrids by Adenosine Deaminases That Act on RNA," Nucleic Acids Research, 2017, vol. 45, No. 6, pp. 3369-3377.
Zhou et al., "Atypical behaviour and connectivity in SHANK3-mutant macaques," Nature, Jun. 20, 2019, vol. 570, pp. 326-331 and pp. 332-349 containing Methods, Figures and Reporting Summary (24 total pages).
Zhou et al., "Off-target RNA mutation induced by DNA base editing and its elimination by mutagenesis," Nature, Jul. 11, 2019, vol. 571, pp. 275-278 and 14 paages containing Methods, Extended Figures, and Report Summary (18 total pages).
Zhou et al., "Cas 12a variants designed for lower genome-wide off-target effect through stringent PAM recognition", Molecular Therapy, Jan. 2022, vol. 30, No. 1 , pp. 1-12.
Zong et al., "Precise base editing in rice, wheat and maize with a Cas9-cytidine deaminase fusion," Nature Biotechnology, 2017, pp. 1-4.
Zuo et al., "Cytosine base editor generates substantial off-target single-nucleotide variants in mouse embryos," Science, Apr. 19, 2019, vol. 364, Article No. 6437, pp. 289-292 and pp. 5-8 containing Figures (8 total pages).
Zuris et al., "Efficient Delivery of Genome-Editing Proteins In Vitro and In Vivo," Nature Biotechnology, Jan. 2015, vol. 33, Article No. 1, pp. 73-80 and pp. 19-26 containing Figures (26 total pages).
Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.
Freshney et al., "Culture of Animal Cells, A Manual of Basic Technique," Food and Chemical Toxicology, 1983, vol. 23, No. 3, pp. 403-404.
Fu et al., "Human cell based directed evolution of adenine base editors with improved efficiency," Nature Communications, 2021, vol. 12, No. 5897, pp. 1-11.
Gao et al. Inflammation negatively regulates FOXP3 and regulatory T-cell function via DBC1. Proceedings of the National Academy of Sciences of the United States of America, Jun. 9, 2015, vol. 112, No. 25, E3246-E3254.
Gardlik et al., "Vectors and delivery systems in gene therapy," Medical Science Monitor, 2005, vol. 11, No. 4, pp. RA110-RA121.
Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.
Gasiunas et al., "RNA-dependent DNA endonuclease Cas9 of the CRISPR system: Holy Grail of genome editing?" Trends in Microbiology, Nov. 2013, vol. 21, No. 11, pp. 562-567.
Gaudelli et al., "Programmable base editing of A•T to G•C in genomic DNA without DNA cleavage," Nature, Nov. 23, 2017, vol. 551, pp. 464-471.
Gaudelli et al., "Directed evolution of adenine base editors with increased activity and therapeutic application," Nature Biotechnology, 2020, pp. 1-18 and pp. 19-37 containing Figures and Methods (37 total pages).
GenBank Accession No. AIT42264.1, downloaded Jan. 9, 2024.

(56) References Cited

OTHER PUBLICATIONS

GenBank Accession No. AKA60242.1, downloaded Jan. 9, 2024.
GenBank Accession No. AKQ21048.1, downloaded Jan. 9, 2024.
GenBank Accession No. AKS40380.1, downloaded Jan. 9, 2024.
GenBank Accession No. CTS26096.1, downloaded Apr. 9, 2024.
GenBank Locus No. LC169509.1, downloaded Aug. 10, 2023.
GenBank NCBI Reference Sequence No. NM_000295.4, downloaded Aug. 23, 2023.
GenBank Protein No. 4UN5_B, downloaded Jan. 9, 2024.
Geneseq, "*Streptococcus pyogenes* Cas9 protein", XP002808136, retrieved from EBI accession No. GSP: BIR16744 Database accession No. BIR16744 sequence -& DATBSE Geneseq [Online], Jan. 21, 2021.
Geneseq, "*Streptococcus pyogenes* Cas9 protein", XP002808135, retrieved from EBI accession No. GSP: BIR16747 Database accession No. BIR16747 sequence -& DATBSE Geneseq [Online], Jan. 21, 2021.
Geneseq, "Adenine deaminase polypeptide SEQ: 49.", XP002808137, retrieved from EBI accession No. GSP: BJG44493 Database accession No. BJG44493 sequence -& DATBSE Geneseq [Online], Jun. 10, 2021.
Greene et al., "Alpha-1 Antitrypsin Deficiency: Recent Developments in Gene Therapy Research," Gene Therapy Application, 2011, vol. 25, pp. 449-460.
Grimm et al., In vitro and In vivo Gene Therapy Vector Evolution via Multispecies Interbreeding and Retargeting of Adeno-Associated Viruses. J. Virol., 2008, vol. 82, p. 5887-5911.
Grunewald et al., "Transcriptome-wide off-target RNA editing induced by CRISPR-guided DNA base editors," Nature, May 16, 2019, vol. 569, pp. 433-437 and pp. 438-453 containing Methods, Figures, Tables and Report Summary (21 total pages).
Grunewald et al., "CRISPR DNA base editors with reduced RNA off-target and self-editing activities," Nature Biotechnology, Sep. 2019, vol. 37, Article No. 9, pp. 1041-1048 and pp. 14-19 containing Figures (19 total pages).
Guilinger et al. "Fusion of catalytically inactive Cas9 to Fokl nuclease improves the specificity of genome modification." Nature Biotechnology, 2014, vol. 32, pp. 577-582.
Guo et al., "Protein tolerance to random amino acid change," Proceedings of the National Academy of Sciences of the United States of America, Jun. 22, 2004, vol. 101, No. 25, pp. 9205-9210.
Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).
Hess et al., "Methods and Applications of CRISPR-Mediated Base Editing in Eukaryotic Genomes," Molecular Cell, Oct. 5, 2017, vol. 68, pp. 26-43.
Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.
Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63 and pp. 64-75 and 1-2 containing Methods, Figures and Life Sciences Reporting Summary (21 total pages).
Hua et al., "Expanding the base editing scope in rice by using Cas9 variants," Plant Biotechnology Journal, 2019, vol. 17, pp. 499-504.
Huang et al., "DNA epigenome editing using CRISPR-Cas SunTag-directed DNMT3A," Genome Biology, 2017, vol. 18, No. 176, pp. 1-11.
Huang et al., "Circularly permuted and PAM-modified Cas9 variants broaden the targeting scope of base editors," Nature Biotechnology, Jun. 2019, vol. 37, No. 6, pp. 626-631 and pp. 11-14 containing Figures (14 total pages).
Jeong et al., "Measurement of deoxyinosine adduct: Can it be a reliable tool to assess oxidative or nitrosative DNA damage?," Toxicology Letters, 2012, vol. 214, pp. 226-233.
Jeong et al., "Precise adenine base editors that exhibit minimized cytosine catalysis," Research Square, 2020, pp. 1-10 and pp. 11-15 containing Figures (15 total pages).
Jeong et al., "Adenine base editor engineering reduces editing of bystander cytosines," Nature Biotechnology, Nov. 2021, vol. 39, pp. 1426-1433 and pp. 1434-1437 containing Methods and Reporting Summary (12 total pages).
Jha et al., "Single amino acid substitutions in recombinant plant-derived human a1-proteinase inhibitor confer enhanced stability and functional efficacy," Biochimica et Biophysica Acta, 2014, vol. 1840, pp. 416-427.
Jiang et al., "Chemical modifications of adenine base editor mRNA and guide RNA expand its application scope," Nature Communications, 2020, vol. 11, No. 1979, pp. 1-9.
Jin et al., "Cytosine, but not adenine, base editors induce genome-wide off-target mutations in rice," Science, Apr. 19, 2019, vol. 364, pp. 292-295.
Jinek et al., "A Programmable Dual-RNA-Guided DNA Endonuclease in Adaptive Bacterial Immunity," Science, Aug. 17, 2012, vol. 337, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-536 and p. 37 containing Online Methods (9 total pages).
June et al., "Chimeric Antigen Receptor Therapy," The New England Journal of Medicine, Jul. 5, 2018, vol. 379, Article No. 1, pp. 64-73.
Kappel et al., "Regulating gene expression in transgenic animals," Current Opinion in Biotechnology, 1992, vol. 3, pp. 548-553.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Kim et al., "Transcriptional Repression by Zinc Finger Peptides: exploring the potential for applications in gene therapy," The Journal of Biological Chemistry, Nov. 21, 1997, vol. 272, No. 47, pp. 29795-29800.
Kim et al., "Structural and Kinetic Characterization of *Escherichia coli* TadA, the Wobble-Specific TRNA Deaminase," Biochemistry, 2006, vol. 45, No. 20, pp. 6407-6416.
Kim et al., "Highly efficient RNA-guided genome editing in human cells via delivery of purified Cas9 ribonucleoproteins," Genome Research, 2014, pp. 1012-1019.
Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 377-385 containing Online Methods, Supplementary Material, Acknowledgments, References and Figures (15 total pages).
Qasim et al., "Molecular remission of infant B-ALL after infusion of universal TALEN gene-edited CAR T cells," Science Translational Medicine, Jan. 25, 2017, vol. 9, No. eaaj2013, pp. 1-8.
Qasim, "Allogeneic CART cell therapies for leukemia", American Journal of Hematology, vol. 94, Feb. 1, 2019, pp. S50-S54.
Qi et al., "Repurposing CRISPR as an RNA-Guided Platform for Sequence-Specific Control of Gene Expression," Cell, Feb. 28, 2013, vol. 152, pp. 1173-1183.
Qianqian, Xiong, "Advances in Diagnosis and Treatment of Glycogen Storage Diseases," Journal of Stroke and Neurological Diseases, 2017, vol. 34, No. 10, pp. 957-960 [English Abstract].
Qing et al., "Research progress on double-stranded RNA-specific adenosine deaminase—DSRAD/ADAR1," Foreign Medical Sciences, 2004, vol. 3, pp. 129-132 [English Abstract Only].
Rajamohan et al., "Current status of drug screening and disease modelling in human pluripotent stem cells," Bioessays, 2012, vol. 35, pp. 281-298.

(56) References Cited

OTHER PUBLICATIONS

Ramakrishna et al., "Gene disruption by cell-penetrating peptide-mediated delivery of Cas9 protein and guide RNA," Genome Research, 2014, vol. 24, pp. 1020-1027.
Ran et al., "In vivo genome editing using *Staphylococcus aureus* Cas9," Nature, Apr. 9, 2015, vol. 520, Article No. 7546, pp. 186-191 and pp. 24-28 containing Figures (28 total pages).
Ranzau et al., "The wild-type tRNA adenosine deaminase enzyme TadA is capable of sequence-specific DNA base editing." Chembiochem, Aug. 2023, vol. 24, No. 16, pp. 1-35.
Rees et al., "Improving the DNA specificity and applicability of base editing through protein engineering and protein delivery," Nature Communications, 2017, vol. 8, No. 15790, pp. 1-10.
Rees et al., "Base editing: precision chemistry on the genome and transcriptome of living cells," Nature Reviews Genetics, Dec. 2018, vol. 19, Article No. 12, pp. 770-788 and pp. 31-41 containing Figures (41 total pages).
Rees et al., "Analysis and minimization of cellular RNA editing by DNA adenine base editors," Science Advances, May 8, 2019, vol. 5, No. eaax5717, pp. 1-10.
Ren et al., "Multiplex Genome Editing to Generate Universal CAR T Cells Resistant to PD1 Inhibition," Clinical Cancer Research, May 1, 2017, vol. 23, No. 9, pp. 2255-2266.
Ribeiro et al., "Protein Engineering Strategies to Expand CRISPR-Cas9 Applications," Hindawi: International Journal of Genomics, 2018, vol. 2018, Article No. 1652567, pp. 1-12.
Richter et al., "Phage-assisted evolution of an adenine base editor with improved Cas domain compatibility and activity," Nature Biotechnology, Jul. 2020, vol. 38, No. 7, pp. 883-891 and pp. 26-31 containing Figures (31 total pages).
Riesenberg et al. "Improved gRNA secondary structures allow editing of target sites resistant to CRISPR-Cas9 cleavage." Nature communications, 2022, vol. 13 No. 1, pp. 489.
Rogozin et al. "Evolution and diversification of lamprey antigen receptors: evidence for involvement of an AID-APOBEC family cytosine deaminase," Nature Immunology, Jun. 2007, vol. 8, No. 6, pp. 647-656.
Rölle et al., "Distinct HLA-E Peptide Complexes Modify Antibody-Driven Effector Functions of Adaptive NK Cells," Cell Reports, Aug. 2018, vol. 24, No. 8, pp. 1967-1976.
Ruffolo, et al., "Design of highly functional genome editors by modeling of the universe of CRISPR-Cas Sequences," bioRxiv, posted Apr. 22, 2024, doi: 10.1101/2024.04.22.590591.
Ryu et al., "Adenine base editing in mouse embryos and an adult mouse model of Duchenne muscular dystrophy," Nature Biotechnology, Jun. 2018, vol. 36, No. 6, pp. 536-539.
Sang, Helen, "Prospects for transgenesis in the chick," Mechanisms of Development, 2004, vol. 121, pp. 1179-1186.
Sang et al., "A unique uracil-DNA binding protein of the uracil DNA glycosylase superfamily," Nucleic Acids Research, Sep. 30, 2015, vol. 43, No. 17, pp. 8452-8463.
Sangkitporn et al., "Hb G Makassar (Beta 6: Glu→ Ala) in a Thai Family," Journal of the Medical Association of Thailand, May 2002, vol. 85, No. 5, pp. 577-582.
Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.
Serreze et al., "Major Histocompatibility Complex Class I-Deficient NOD-B2mnull Mice are Diabetes and Insulitis Resistant," Diabetes, Mar. 1994, vol. 43, pp. 505-509.
Shah et al., "Efficient and versatile CRISPR engineering of human neurons in culture to model neurological disorders," Wellcome Open Research, Nov. 15, 2016, vol. 1, No. 13, pp. 1-18 and pp. 19-21 containing Open Peer Review (21 total pages).
Shah et al., "MeCP2 mutations: progress towards understanding and treating Rett syndrome," Genome Medicine, 2017, vol. 9, No. 17, pp. 1-4.
Shee et al., "Engineered proteins detect spontaneous DNA breakage in human and bacterial cells," eLife, 2013, vol. 2, No. e01222, pp. 1-25.
Shen et al., "Amelioration of Alpha-1 Antitrypsin Deficiency Diseases with Genome Editing in Transgenic Mice," Human Gene Therapy, 2018, vol. 29, No. 8, pp. 861-873.
Shimomura et al., "Complete genome sequencing and analysis of a Lancefield group G *Streptococcus dysgalactiae* subsp. equisimilis strain causing streptococcal toxic shock syndrome (STSS)," BMC Genomics, 2011, vol. 12, No. 17, pp. 1-17.
Shmakov et al., "Discovery and Functional Characterization of Diverse Class 2 CRISPR-Cas Systems," Molecular Cell, Nov. 5, 2015, vol. 60, pp. 385-397.
Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.
Sinnamon et al., "Site-directed RNA repair of endogenous Mecp2 RNA in neurons," Proceedings of the National Academy of Sciences of the United States of America, Oct. 16, 2017, pp. E9395-E9402.
Slaymaker et al., "Rationally engineered Cas9 nucleases with improved specificity," Science, Jan. 1, 2016, vol. 351, No. 6268, pp. 84-88.
Smith et al., "Efficient and Allele-Specific Genome Editing of Disease Loci in Human iPSCs," Molecular Therapy, Mar. 2015, vol. 23, No. 3, pp. 570-577.
Song et al. "Delivery of CRISPR/Cas systems for cancer gene therapy and immunotherapy." Advanced Drug Delivery Reviews, 2021, vol. 168, pp. 150-180.
Stadtmauer et al., "First-in-Human Assessment of Feasibility and Safety of Multiplexed Genetic Engineering of Autologous T Cells Expressing NY-ESO-1 TCR and CRISPR/Cas9 Gene Edited to Eliminate Endogenous TCR and PD-1 (Nyce T cells) in Advanced Multiple Myeloma (MM) and Sarcoma," Blood, 2019, vol. 134, No. Suppl. 1, p. 49.
Stanton et al. "Systemic administration of novel engineered AAV capsids facilitates enhanced transgene expression in the macaque CNS." Med, 2023, vol. 4. No. 1, pp. 31-50.
Talbot et al., "Spinal muscular atrophy," Journal of Inherited Metabolic Disease, Jun. 2001, vol. 21, No. 2, pp. 189-197 [Abstract Only].
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
Themeli et al., "New Cell Sources for T Cell Engineering and Adoptive Immunotherapy," Cell Stem Cell, Apr. 2, 2015, vol. 16, pp. 357-366.
Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.
Tipanee, et al. "Transposons: Moving Forward from Preclinical Studies to Clinical Trials," Human Gene Therapy, Nov. 2017, pp. 1087-1104.
Tsai et al. "Dimeric CRISPR RNA-guided FokI nucleases for highly specific genome editing." Nature Biotechnology, Apr. 2014, vol. 32, No. 6, pp. 569-576.
Tsai et al., "GUIDE-seq enables genome-wide profiling of off-target cleavage by CRISPR-Cas nucleases," Nature Biotechnology, Feb. 2015, vol. 33, Article No. 2, pp. 187-197 and pp. 16-23 containing Figures (23 total pages).
UniProt Accession No. A0A5F1IHX6, downloaded Apr. 11, 2023.
UniProt Accession No. A8AD26, downloaded Apr. 11, 2023.
UniProt Accession No. P01011, Downloaded Oct. 18, 2023.
Kim et al., "Highly efficient RNA-guided base editing in mouse embryos," Nature Biotechnology, 2017, pp. 1-4.

(56) References Cited

OTHER PUBLICATIONS

Kim et al., "Rescue of high-specificity Cas9 variants using sgRNAs with matched 5' nucleotides," Genome Biology, 2017, vol. 18, No. 218, pp. 1-6.
Kim et al., "Adenine base editors catalyze cytosine conversions in human cells," Nature Biotechnology, Oct. 2019, vol. 37, pp. 1145-1148 and pp. 1149-1151 containing Methods and Reporting Summary (7 total pages).
Kitamura et al., "Uracil DNA Glycosylase Counteracts APOBEC3G-Induced Hypermutation of Hepatitis B Viral Genomes: Excision Repair of Covalently Closed Circular DNA," PLOS Pathogens, May 2013, vol. 9, No. 5, e1003361, pp. 1-14.
Kleinstiver et al., "Broadening *Staphylococcus aureus* Cas9 Targeting Range by Modifying PAM Recognition," Nature Biotechnology, Dec. 2015, vol. 33, Article No. 12, pp. 1293-1298 and pp. 12-14 containing Figures (14 total pages).
Kleinstiver et al., "Engineered CRISPR-Cas9 nucleases with altered PAM specificities," Nature, Jul. 23, 2015, vol. 523, pp. 481-485 and pp. 486-497 containing Methods and Figures (17 total pages).
Kleinstiver et al., "High-fidelity CRISPR-Cas9 variants with undetectable genome-wide off-targets," Molecular Therapy, Jan. 28, 2016, vol. 529, Article No. 75187, pp. 490-495 and pp. 20-24 containing Figures (24 total pages).
Koblan et al., "Improving cytidine and adenine base editors by expression optimization and ancestral reconstruction," Nature Biotechnology, Oct. 2018, vol. 36, Article No. 9, pp. 843-846 and pp. 9-11 containing Figures (11 total pages).
Komor et al., "Programmable editing of a target base in genomic DNA without double-stranded DNA cleavage," Nature, May 19, 2016, vol. 533, pp. 420-424.
Komor et al., "CRISPR-Based Technologies for the Manipulation of Eukaryotic Genomes," Cell, Jan. 12, 2017, vol. 168, pp. 20-36 and pp. 37-38 containing Update and Corrections (19 total pages).
Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.
Kundu et al., "Leucine to proline substitution by SNP at position 197 in Caspase-9 gene expression leads to neuroblastoma: a bioinformatics analysis," 3 Biotech, 2013, vol. 3, pp. 225-234.
Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.
Lapinaite et al., "DNA capture by a CRISPR-Cas9-guided adenine base editor," Science, Jul. 31, 2020, vol. 369, pp. 566-571.
Lau et al., "Molecular Basis for Discriminating between Normal and Damaged Bases by the Human Alkyladenine Glycosylase, AAG," Proceedings of the National Academy of Sciences of the United States of America, Dec. 5, 2000, vol. 97, No. 25, pp. 13573-13578.
Lavergne et al., "Defects in type IIA von Willebrand disease: a cysteine 509 to arginine substitution in the mature von Willebrand factor disrupts a disulphide loop involved in the interaction with platelet glycoprotein Ib-IX," British Journal of Haematology, 1992, vol. 82, pp. 66-72.
Lazar et al., "Transforming Growth Factor $\alpha$: Mutation of Aspartic Acid 47 and Leucine 48 Results in Different Biological Activities," Molecular and Cellular Biology, Mar. 1988, vol. 8, No. 3, pp. 1247-1252.
Le et al., "SMND7, the major product of the centromeric survival motor neuron (SMN2 ) gene, extends survival in mice with spinal muscular atrophy and associates with full-length SMN," Human Molecular Genetics, 2005, vol. 14, No. 6, pp. 845-857.
Lee et al., "PIK3CA gene is frequently mutated in breast carcinomas and hepatocellular carcinomas," Oncogene, 2005, vol. 24, pp. 1477-1480.
Lee et al., "Cytosine but not adenine base editor generates mutations in mice," bioRxiv, 2019, pp. 1-14 and pp. 15-24 containing Figures (24 total pages).
Lee et al., "CRISPR-Pass: Gene Rescue of Nonsense Mutations Using Adenine Base Editors," Molecular Therapy, Aug. 2019, vol. 27, No. 8, pp. 1364-1371.
Lefebvre et al., "Identification and Characterization of a Spinal Muscular Atrophy-Determining Gene," Jan. 13, 1995, vol. 80, pp. 155-165.
Lei et al., "Glucose-6-phosphatase dependent substrate transport in the glycogen storage disease type-1a mouse," Nature Genetics, Jun. 1996, vol. 13, pp. 203-209.
Leibundgut-Landmann et al., "Mini-review: Specificity and expression of CIITA, the master regulator of MHC class II genes," European Journal of Immunology, 2004, vol. 34, pp. 1513-1525.
Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.
Li et al., "Current Approaches for Engineering Proteins with Diverse Biological Properties," Bio-Applications of Nanoparticles, 2007, pp. 1-16.
Li et al. "Base editing with a Cpf1-cytidine deaminase fusion." Nature biotechnology, 2018, vol. 36, No. 4, pp. 324-327.
Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].
Liu et al., "C2c1-sgRNA Complex Structure Reveals RNA-Guided DNA Cleavage Mechanism," Molecular Cell, Jan. 19, 2017, vol. 65, pp. 310-322.
Liu et al., "Research Progress of Base Editing System," World Sci-Tech R&D, Dec. 2017, vol. 39, No. 6, pp. 457-462 [English Abstract].
Liu et al., "CRISPR-Cas9-mediated multiplex gene editing in CAR-T cells," Cell Research, Jan. 2017, vol. 27, No. 1, pp. 154-157.
Liu et al., "Supplementary information, Figure S1. Multiplex gene editing mediated by CRISPR-Cas9 in primary T cells," Cell Research, Jan. 2017, pp. 1-3 <https://static-content.springer.com/esm/art%3A10.1038%2Fcr.2016.142/MediaObjects/41422_2017_BFcr2016142_MOESM20_ESM.pdf>.
Liu, et al. "Crossing the blood-brain barrier with AAV vectors," Metabolic Brain Disease, 2021, vol. 36, pp. 45-52.
Lorson et al., "A single nucleotide in the SMN gene regulates splicing and is responsible for spinal muscular atrophy," Proceedings of the National Academy of Sciences of the United States of America, May 1999, vol. 96, pp. 6307-6311.
Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.
Lyons et al., "Efficient Recognition of an Unpaired Lesion by a DNA Repair Glycosylase," Journal of the American Chemical Society, 2009, vol. 131, No. 49, pp. 17742-17743.
Ma et al., "Targeted AID-mediated mutagenesis (TAM) enables efficient genomic diversification in mammalian cells," Nature Methods, Dec. 2016, vol. 13, No. 12, pp. 1029-1035 and pp. 1036-1037 containing Online Methods (9 total pages).
Maeder et al. "CRISPR RNA-guided activation of endogenous human genes", Nature Methods, Oct. 2013, vol. 10, No. 10, pp. 977-979.
Majzner et al., "Tumor Antigen Escape from CAR T-cell Therapy," Cancer Discovery, Oct. 2018, vol. 8, No. 10, pp. 1219-1226.
Makarova et al., "Classification and Nomenclature of CRISPR-Cas Systems: Where from Here?," The CRISPR Journal, 2018, vol. 1, No. 5, pp. 325-336.
Mali et al., "Cas9 as a versatile tool for engineering biology," Nature Methods, Oct. 2013, vol. 10, No. 10, pp. 957-963.
Mali et al., "CAS9 transcriptional activators for target specificity screening and paired nickases for cooperative genome engineering," Nature Biotechnology, Sep. 2013, vol. 31, Article No. 9, pp. 833-838 and pp. 13-17 containing Figures (17 total pages).
Mariani et al. "Species-specific exclusion of APOBEC3G from HIV-1 virions by Vif." Cell, 2003, vol. 114, No. 1, 21-31.
Mccann et al., "MagnEdit-interacting factors that recruit DNA-editing enzymes to single base targets," Life Science Alliance, 2020, vol. 3, No. 4, e201900606, pp. 1-9.

(56) References Cited

OTHER PUBLICATIONS

Mejstrikova et al., "CD19-negative relapse of pediatric B-cell precursor acute lymphoblastic leukemia following blinatumomab treatment," Blood Cancer Journal, 2017, vol. 7, No. 659, pp. 1-5.
Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).
Mikami et al., "Comparison of CRISPR/Cas9 expression constructs for efficient targeted mutagenesis in rice," Plant Molecular Biology, 2015, vol. 88, pp. 561-572.
Miller et al., "Continuous evolution of SpCas9 variants compatible with non-G PAMs," Nature Biotechnology, Apr. 2020, vol. 38, No. 4, pp. 471-481 and pp. 25-32 containing Figures (32 total pages).
Mohamad et al., "Human hemoglobin G-Makassar variant masquerading as sickle cell anemia," Hematology Reports, 2018, vol. 10, No. 7210, pp. 92-95.
Monani et al., "A single nucleotide difference that alters splicing patterns distinguishes the SMA gene SMN1 from the copy gene SMN2," Human Molecular Genetics, 1999, vol. 8, No. 7, pp. 1177-1183.
Addgene Plasmid No. 44246, downloaded Aug. 23, 2023.
Addgene Plasmid No. 73021, downloaded Aug. 23, 2023.
Addgene Plasmid No. 79620, downloaded Aug. 23, 2023.
Alexandrov et al., "Signatures of mutational processes in human cancer," Nature, Aug. 22, 2013, vol. 500, pp. 415-421 and pp. 422-425 containing Methods, Corrections, and Amendments (11 total pages).
Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.
Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.
Azad et al., "Site-directed RNA editing by adenosine deaminase acting on RNA for correction of the genetic code in gene therapy," Gene Therapy, 2017, vol. 24, pp. 779-786.
Bae et al., "Cas-OFFinder: a fast and versatile algorithm that searches for potential off-target sites of Cas9 RNA-guided endonucleases," Bioinformatics, 2014, vol. 30, No. 10, pp. 1473-1475.
Baligar et al., "Bone Marrow Stem Cell Therapy Partially Ameliorates Pathological Consequences in Livers of Mice Expressing Mutant Human α1-Antitrypsin," Hepatology, Apr. 2017, vol. 65, No. 4, pp. 1319-1335.
Baños-Sanz et al., "Crystal structure and functional insights into uracil-DNA glycosylase inhibition by phage ϕ29 DNA mimic protein p56," Nucleic Acids Research, 2013, vol. 41, No. 13, pp. 6761-6773.
BC021560, European Nucleotide Archive Accession No. BC021560, *Homo sapiens* deleted in bladder cancer 1, mRNA (cDNA clone), complete eds., Jan. 22, 2002 [online]. [Retrieved on Oct. 2, 2023]. Retrieved from the Internet <URL: https://www.ebi.ac.uk/ena/browser/view/BC021560> Entire document.
Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079 and pp. e1-e4 and 1-12 containing Star Methods and Supplemental Information (29 total pages).
Bjursell et al., "Therapeutic Genome Editing With CRISPR/Cas9 in a Humanized Mouse Model Ameliorates α1-antitrypsin Deficiency Phenotype," EBioMedicine, 2018, vol. 29, pp. 104-111.
Branden and Tooze, "The Building Blocks," Introduction to Protein Structure, 1999, vol. 2, pp. 3-12.
Briner et al., "Guide RNA Functional Modules Direct Cas9 Activity and Orthogonality," Molecular Cell, Oct. 23, 2014, vol. 56, pp. 333-339.
Bulow et al., "Multienzyme systems obtained by gene fusion," Trends in Biotechnology, Jul. 1991, vol. 9, pp. 226-231.
Burstein et al., "New CRISPR-Cas systems from uncultivated microbes," Nature, Feb. 9, 2017, vol. 542, Article No. 7640, pp. 237-241 and pp. 242-264 containing Methods, Extended Data, and Figures (28 total pages).
Cameron, Ewan R., "Recent Advances in Transgenic Technology," Molecular Biotechnology, 1997, vol. 7, pp. 253-265.
Canver et al., "Customizing the genome as therapy for the B-hemoglobinopathies," Blood, May 26, 2016, vol. 127, No. 21, pp. 2536-2545.
Cartegni et al., "Determinants of Exon 7 Splicing in the Spinal Muscular Atrophy Genes, SMN1 and SMN2," The American Journal of Human Genetics, Jan. 2006, vol. 78, pp. 63-77.
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Article No. 9, pp. 1741-1747.
Chang et al., "Degradation of survival motor neuron (SMN) protein is mediated via the ubiquitin/proteasome pathway," Neurochemistry International, 2004, vol. 45, pp. 1107-1112.
Charpentier et al. "Rewriting a genome", Nature, Mar. 2013, vol. 495, No. 7439, pp. 50-51.
Chatterjee et al., "A Cas9 with PAM recognition for adenine dinucleotides," Nature Communications, 2020, vol. 11, No. 2474, pp. 1-6.
Chen et al. "Targeting genomic rearrangements in tumor cells through Cas9-mediated insertion of a suicide gene." Nature Biotechnology, Jun. 2017, vol. 35, No. 6, pp. 543-552.
Cheng et al., "Cloning, expression and activity identification of human innate immune protein apolipoprotein B mRNA editing enzyme catalytic subunit 3A (APOBEC3A)," Chinese Journal of Cellular and Molecular Immunology, 2017, vol. 33, No. 2, pp. 179-184 [English Abstract].
Chester et al., "The apolipoprotein B mRNA editing complex performs a multifunctional cycle and suppresses nonsense-mediated decay," The EMBO Journal, 2003, vol. 22, No. 15, pp. 3971-3982.
Chichili et al., "Linkers in the structural biology of protein-protein interactions," Protein Science, 2013, vol. 22, pp. 153-167.
Cho et al., "A degron created by SMN2 exon 7 skipping is a principal contributor to spinal muscular atrophy severity," Genes & Development, 2010, vol. 24, pp. 438-442.
Chylinski et al., "The tracrRNA and Cas9 families of type II CRISPR-Cas immunity systems," RNA Biology, May 2013, vol. 10, No. 5, pp. 726-737.
Collantes et al., "Development and Characterization of a Modular CRISPR and RNA Aptamer Mediated Base Editing System," The CRISPR Journal, 2021, vol. 4, No. 1, pp. 58-68.
Cong et al., "Multiplex Genome Engineering Using CRISPR/Cas Systems," Science, Feb. 15, 2013, vol. 339, Article No. 6121, pp. 819-823 and pp. 6-9 containing Figures (9 total pages).
Cooper et al., "An "off-the-shelf" fratricide-resistant CAR-T for the treatment of T cell hematologic malignancies", Blood Cancer Journal, vol. 32, No. 9, Feb. 20, 2018, pp. 1970-1983.
Cooper et al., "Chimeric antigen 1-5 receptor T cells (CAR-T) for the treatment of T-cell malignancies", Best Practice & Research Clinical Haematology, vol. 32, No. 4, Oct. 2019.
Corcia et al., "The importance of the SMN genes in the genetics of sporadic ALS," Amyotrophic Lateral Sclerosis, 2009, vol. 10, pp. 436-440.
Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).
Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.

(56) References Cited

OTHER PUBLICATIONS

Dai et al., "Bispecific CAR-T cells targeting both CD19 and CD22 for therapy of adults with relapsed or refractory B cell acute lymphoblastic leukemia," Journal of Hematology & Oncology, 2020, vol. 13, No. 30, pp. 1-11.
De Souza. "Primer: genome editing with engineered nucleases." Nature Methods, vol. 9, No. 1, Jan. 2012, pp. 27-27.
Deltcheva et al., "CRISPR RNA maturation by trans-encoded small RNA and host factor RNase III," Nature, Mar. 31, 2011, vol. 471, pp. 602-607 and pp. 608-609 containing Methods (8 total pages).
Depil et al., "'Off-the-shelf' allogeneic CAR T cells: development and challenges," Nature Reviews Drug Discovery, 2020, vol. 19, Article No. 3, pp. 185-199.
Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).
D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.
Edwards Aaron et al: "Base Editors Generate Allogeneic CAR-T Cells with No Detectable Genomic Rearrangements and Reduced Genotoxicity", Molecular Therapy; 22nd Annual Meeting of the American-Society-of-Gene-and-Cell-Therapy (ASGCT), Apr. 29-May 2, 2019, vol. 27, No. 4, Suppl. 1, Apr. 22, 2019, pp. 74.
Eid et al., "CRISPR base editors: genome editing without double-stranded breaks," Biochemical Journal, 2018, vol. 475, pp. 1955-1964.
Ekstrand et al., "Frequent alterations of the PI3K/AKT/mTOR pathways in hereditary nonpolyposis colorectal cancer," Familial Cancer, 2010, vol. 9, pp. 125-129.
Endo et al., "Toward establishing an efficient and versatile gene targeting system in higher plants," Biocatalysis and Agricultural Biotechnology, 2014, vol. 3, pp. 2-6.
Fagagna et al., "The Gam protein of bacteriophage Mu is an orthologue of eukaryotic Ku," EMBO reports, 2003, vol. 4, No. 1, pp. 47-52.
Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.
International Search Report and Written Opinion from corresponding International PCT Application No. PCT/US2021/052035, mailed Jan. 20, 2022.

| | Sample Name | Subset Name |
|---|---|---|
| | RCM 2020-11-02 F2 Editing.0001.fcs | CD45+ |
| | RCM 2020-11-02 F1 Editing.0001.fcs | CD45+ |
| | RCM 2020-11-02 E6 Editing.0001.fcs | CD45+ |
| | RCM 2020-11-02 E5 Editing.0001.fcs | CD45+ |
| | RCM 2020-11-02 E4 Editing.0001.fcs | CD45+ |
| | RCM 2020-11-02 E3 Editing.0001.fcs | CD45+ |
| | RCM 2020-11-02 E2 Editing.0001.fcs | CD45+ |
| | RCM 2020-11-02 E1 Editing.0001.fcs | CD45+ |
| | RCM 2020-11-02 D12 Editing.0001.fcs | CD45+ |
| | RCM 2020-11-02 D11 Editing.0001.fcs | CD45+ |
| | RCM 2020-11-02 D10 Editing.0001.fcs | CD45+ |
| | RCM 2020-11-02 D9 Editing.0001.fcs | CD45+ |
| | RCM 2020-11-02 D8 Editing.0001.fcs | CD45+ |
| | RCM 2020-11-02 D7 Editing.0001.fcs | CD45+ |
| | RCM 2020-11-02 D6 Editing.0001.fcs | CD45+ |
| | RCM 2020-11-02 D5 Editing.0001.fcs | CD45+ |
| | RCM 2020-11-02 D4 Editing.0001.fcs | CD45+ |
| | RCM 2020-11-02 D3 Editing.0001.fcs | CD45+ |
| | RCM 2020-11-02 D2 Editing.0001.fcs | CD45+ |
| | RCM 2020-11-02 D1 Editing.0001.fcs | CD45+ |

| | |
|---|---|
| F2 | EP Only (no CD2 edit) |
| F1 | UTD |
| E6 | LV123 (no CD2 edit) |
| E5 | LV122 (no CD2 edit) |
| E4 | LV121 (no CD2 edit) |
| E3 | LV120 (no CD2 edit) |
| E2 | LV119 (no CD2 edit) |
| E1 | LV118 (no CD2 edit) |
| D12 | LV129 |
| D11 | LV128 |
| D10 | LV127 |
| D9 | LV126 |
| D8 | LV125 |
| D7 | LV124 |
| D6 | LV123 |
| D5 | LV122 |
| D4 | LV121 |
| D3 | LV120 |
| D2 | LV119 |
| D1 | LV118 |

FIG. 8F (continued)

FRATRICIDE RESISTANT MODIFIED IMMUNE CELLS AND METHODS OF USING THE SAME

CROSS REFERENCE TO RELATED APPLICATIONS

This present application is the U.S. National Stage Application, pursuant to 35 U.S.C. § 371 of PCT International Application No. PCT/US2021/052035, filed Sep. 24, 2021 designating the United States and published in English, which claims priority to and the benefit of U.S. Provisional Application No. 63/083,540, filed on Sep. 25, 2020, the entire contents of which are hereby incorporated by reference herein in its entirety.

SEQUENCE LISTING

This application contains a Sequence Listing which has been submitted electronically in ASCII format and is hereby incorporated by reference in its entirety. Said ASCII copy, created on Sep. 24, 2021 date, is named 180802-045001PCT_SL.txt and is 2,266,391 bytes in size.

BACKGROUND OF THE DISCLOSURE

Autologous and allogeneic immunotherapies are neoplasia treatment approaches in which immune cells expressing chimeric antigen receptors are administered to a subject. To generate an immune cell that expresses a chimeric antigen receptor (CAR), the immune cell is first collected from the subject (autologous) or a donor separate from the subject receiving treatment (allogeneic) and genetically modified to express the chimeric antigen receptor. The resulting cell expresses the chimeric antigen receptor on its cell surface (e.g., CAR T-cell), and upon administration to the subject, the chimeric antigen receptor binds to the marker expressed by the neoplastic cell. This interaction with the neoplasia marker activates the CAR-T cell, which then cell kills the neoplastic cell. But for autologous or allogeneic cell therapy to be effective and efficient, significant conditions and cellular responses must be overcome or avoided. Shared expression of target antigens on both neoplastic and healthy immune cells may provide additional challenges, such as T-cell fratricide. Editing genes involved in this process can enhance CAR-T cell function and create resistance to fratricide, but current methodologies for making such edits have the potential to induce large, genomic rearrangements in the CAR-T cell, thereby negatively impacting its efficacy. Thus, there is a significant need for techniques to more precisely modify immune cells, especially CAR-T cells. This application is directed to this and other important needs.

SUMMARY OF THE DISCLOSURE

As described below, the present invention features genetically modified immune cells (e.g., T- or NK-cells) having enhanced anti-neoplasia activity and fratricide resistance. The present invention also features methods for producing and using these modified immune cells. Methods of treating neoplasia (e.g., T- or NK-cell malignancies) using fratricide resistant modified immune cells are also provided.

In one aspect, the invention provides a chimeric antigen receptor (CAR) comprising an anti-CD2 binding domain; and a CD2 signaling domain. In some embodiments, the CAR further includes a transmembrane domain and one or more additional signaling domains. In some embodiments, the transmembrane domain is a CD8• transmembrane domain. In some embodiments, the one or more additional signaling domains is selected from a CD3• signaling domain, a CD28 signaling domain, and a CD137 (4-1BB) signaling domain. In some embodiments, the one or more additional signaling domains is a CD3• signaling domain.

In another aspect, the invention provides a chimeric antigen receptor (CAR) comprising an anti-CD2 binding domain; a CD8• transmembrane domain; a CD2 signaling domain and/or a CD28 signaling domain; and a CD3• signaling domain. In some embodiments, the CD2 signaling domain is replaced with a CD28 signaling domain. In some embodiments, the CAR further includes the CD28 signaling domain and/or a CD137 (4-1BB) signaling domain. In some embodiments, the CAR further includes a leader peptide sequence. In some embodiments, the leader peptide sequence is at least 85%, at least 90%, at least 95%, at least 98%, at least 99%, or 100% identical to the following amino acid sequence: METDTLLLWVLLLWVPGSTG. In some embodiments, the CD2 signaling domain is at least 85%, at least 90%, at least 95%, at least 98%, at least 99%, or 100% identical to a CD2 cytoplasmic domain. In some embodiments, the CD2 cytoplasmic domain is at least 85%, at least 90%, at least 95%, at least 98%, at least 99%, or 100% identical to residues 235-351 of a human CD2 cytoplasmic domain. In some embodiments, the CD2 signaling domain is at least 85%, at least 90%, at least 95%, at least 98%, at least 99%, or 100% identical to the following amino acid sequence:

TKRKKORSRRNDEELETRAHRVATEERGRKPHQIPASTPONPATSQHPPPPPGHRSQAP SHRPPPPGHRVQHQPOKRPPAPSGTQVHQQKGPPLPRPRVOPKPPHGAAENSLSPSSN (SEQ ID NO: 370). In some embodiments, the CD8• transmembrane domain is at least 85%, at least 90%, at least 95%, at least 98%, at least 99%, or 100% identical to the following amino acid sequence: SDPTTTPAPRPPTPAPTIASQPLSLRPEACRPAAGGAVHTRGLDFACDIYIWAPLAGTCGVLLL SLVITLYC (SEQ ID NO: 371). In some embodiments, the CD3• signaling domain is at least 85%, at least 90%, at least 95%, at least 98%, at least 99%, or 100% identical to the following amino acid sequence: RVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQA LPPR (SEQ ID NO: 372). In some embodiments, the CD28 signaling domain is at least 85%, at least 90%, at least 95%, at least 98%, at least 99%, or 100% identical to the following amino acid sequence: RSKRSRLLHSDYMNMTPRRPGPTRKHYQPYAPPRDFAAYRS (SEQ ID NO: 373). In some embodiments, the CD137 (4-1BB) signaling domain is at least 85%, at least 90%, at least 95%, at least 98%, at least 99%, or 100% identical to one of the following amino acid sequences:

```
                                   (SEQ ID NO: 374)
KRGRKKLLYIFKQPFMRPVQTTQEEDGCSCRFPEEEEGGCEL;
or

                                   (SEQ ID NO: 375)
RFSVVKRGRKKLLYIFKQPFMRPVQTTQEEDGCSCRFPEEEEGGCEL.
```

In some embodiments, the anti-CD2 binding domain comprises an scFv light chain sequence that is at least 85%, at least 90%, at least 95%, at least 98%, at least 99%, or 100% identical to one of the following amino acid sequences:

(SEQ ID NO: 376)
DVVLTQTPPTLLATIGQSVSISCRSSQSLLHSSGNTYLNWLLQRTGQSP
QPLIYLVSKLESGVPNRFSGSGSGTDFTLKISGVEAEDLGVYYCMQFTH
YPYTFGAGTKLELK;

(SEQ ID NO: 377)
EVQLQQSGPELQRPGASVKLSCKASGYIFTEYYMYWVKQRPKQQLELVG
RIDPEDGSIDYVEKFKKKATILTADTSSNTAYMQLSSLTSEDTATYFCA
RGKFNYRFAYWGQGTLVTVSS;

(SEQ ID NO: 378)
DVVMTQSPPSLLVTLGQPASISCRSSQSLLHSSGNTYLNWLLQRPGQSP
QPLIYLVSKLESGVPDRFSGSGSGTDFTLKISGVEAEDVGVYYCMQFTH
YPYTFGQGTKLEIK;

(SEQ ID NO: 379)
QVQLVQSGAEVKKPGASVKVSCKASGYTFTEYYMYWVRQAPGQGLELMG
RIDPEDGSIDYVEKFKKKVTLTADTSSSTAYMELSSLTSDDTAVYYCAR
GKFNYRFAYWGQGTLVTVSS;

(SEQ ID NO: 378)
DVVMTQSPPSLLVTLGQPASISCRSSQSLLHSSGNTYLNWLLQRPGQSP
QPLIYLVSKLESGVPDRFSGSGSGTDFTLKISGVEAEDVGVYYCMQFTH
YPYTFGQGTKLEIK;
or (SEQ ID NO: 380)
QVQLVQSGAEVKKPGASVKVSCKASGYTFTGYYMHWVRQAPGQGLEWMG
RINPNSGGTNYAQKFQGRVTMTRDTSISTAYMELSRLRSDDTAVYYCAR
GRTEYIVVAEGFDYWGQGTLVTVSS.

In some embodiments, the anti-CD2 binding domain comprises an scFv heavy chain sequence that is at least 85%, at least 90%, at least 95%, at least 98%, at least 99%, or 100% identical to one of the following amino acid sequences:

(SEQ ID NO: 376)
EVQLQQSGPELQRPGASVKLSCKASGYIFTEYYMYWVKQRPKQQL
ELVGRIDPEDGSIDYVEKFKKKATLTADTSSNTAYMQLSSLTSED
TATYFCARGKENYRFAYWGQGTLVTVSS;

(SEQ ID NO: 377)
DVVLTQTPPTLLATIGQSVSISCRSSQSLLHSSGNTYLNWLLQRT
GQSPQPLIYLVSKLESGVPNRFSGSGSGTDFTLKISGVEAEDLGV
YYCMQFTHYPYTEGAGTKLELK;

(SEQ ID NO: 379)
QVQLVQSGAEVKKPGASVKVSCKASGYTFTEYYMYWVRQAPGQGL
ELMGRIDPEDGSIDYVEKEKKKVILTADTSSSTAYMELSSLTSDD
TAVYYCARGKENYRFAYWGQGTLVTVSS;

(SEQ ID NO: 378)
DVVMTQSPPSLLVTLGQPASISCRSSQSLLHSSGNTYLNWLLQRP
GQSPQPLIYLVSKLESGVPDRFSGSGSGTDFTLKISGVEAEDVGV
YYCMQFTHYPYTFGQGTKLEIK;

-continued (SEQ ID NO: 380)
QVQLVQSGAEVKKPGASVKVSCKASGYTFTGYYMHWVRQAPGQGL
EWMGRINPNSGGTNYAQKEQGRVTMTRDTSISTAYMELSRLRSDD
TAVYYCARGRTEYIVVAEGFDYWGQGTLVTVSS;
and (SEQ ID NO: 378)
DVVMTQSPPSLLVTLGQPASISCRSSQSLLHSSGNTYLNWLLQRP
GQSPQPLIYLVSKLESGVPDRESGSGSGTDFTLKISGVEAEDVGV
YYCMQFTHYPYTFGQGTKLEIK.

In some embodiments, the CAR further includes a linker. In some embodiments, the linker links the scFv light chain sequence to the scFv heavy chain sequence of the anti-CD2 binding domain. In some embodiments, the linker comprises the sequence $(GGGGS)_n$ (SEQ ID NO: 247), wherein n is an integer from 1 to 10. In some embodiments, the linker comprises the sequence $(GGGGS)_3$ (SEQ ID NO: 381).

In some embodiments, the anti-CD2 binding domain comprises an anti-CD2 scFv that is at least 85%, at least 90%, at least 95%, at least 98%, at least 99%, or 100% identical to one of the following amino acid sequences:

(SEQ ID NO: 382)
DVVLTQTPPTLLATIGQSVSISCRSSQSLLHSSGNTYLNWLLQRT
GQSPQPLIYLVSKLESGVPNRFSGSGSGTDFTLKISGVEAEDLGV
YYCMQFTHYPYTFGAGTKLELKGGGGSGGGGSGGGGSEVQLQQSG
PELQRPGASVKLSCKASGYIFTEYYMYWVKQRPKQQLELVGRIDP
EDGSIDYVEKFKKKATLTADTSSNTAYMQLSSLTSEDTATYFCAR
GKENYRFAYWGQGTLVTVSS;

(SEQ ID NO: 383)
EVQLQQSGPELQRPGASVKLSCKASGYIFTEYYMYWVKQRPKQQL
ELVGRIDPEDGSIDYVEKEKKKATLTADTSSNTAYMQLSSLTSED
TATYFCARGKENYRFAYWGQGTLVTVSSGGGGSGGGGSGGGGSDV
VLTQTPPTLLATIGQSVSISCRSSQSLLHSSGNTYLNWLLQRTGQ
SPQPLIYLVSKLESGVPNRESGSGSGTDFTLKISGVEAEDLGVYY
CMQFTHYPYTFGAGTKLELK;

(SEQ ID NO: 384)
DVVMTQSPPSLLVTLGQPASISCRSSQSLLHSSGNTYLNWLLQRP
GQSPQPLIYLVSKLESGVPDRFSGSGSGTDFTLKISGVEAEDVGV
YYCMQFTHYPYTFGQGTKLEIKGGGGSGGGGSGGGGSQVQLVQSG
AEVKKPGASVKVSCKASGYTFTEYYMYWVRQAPGQGLELMGRIDP
EDGSIDYVEKFKKKVTLTADTSSSTAYMELSSLISDDTAVYYCAR
GKENYRFAYWGQGTLVTVSS;

(SEQ ID NO: 385)
QVQLVQSGAEVKKPGASVKVSCKASGYTFTEYYMYWVRQAPGQGL
ELMGRIDPEDGSIDYVEKEKKKVTLTADTSSSTAYMELSSLTSDD
TAVYYCARGKENYRFAYWGQGTLVTVSSGGGGSGGGGSGGGGSDV
VMTQSPPSLLVTLGQPASISCRSSQSLLHSSGNTYLNWLLQRPGQ

-continued

SPQPLIYLVSKLESGVPDRFSGSGSGTDFTLKISGVEAEDVGVYY

CMQFTHYPYTFGQGTKLEIK;

(SEQ ID NO: 386)
DVVMTQSPPSLLVTLGQPASISCRSSQSLLHSSGNTYLNWLLQRP

GQSPQPLIYLVSKLESGVPDRFSGSGSGTDFTLKISGVEAEDVGV

YYCMQFTHYPYTFGQGTKLEIKGGGGSGGGGSGGGGSQVQLVQSG

AEVKKPGASVKVSCKASGYTFTGYYMHWVRQAPGQGLEWMGRINP

NSGGTNYAQKFQGRVTMTRDTSISTAYMELSRLRSDDTAVYYCAR

GRTEYIVVAEGFDYWGQGTLVTVSS;
or

-continued (SEQ ID NO: 387)
QVQLVQSGAEVKKPGASVKVSCKASGYTFTGYYMHWVRQAPGQGLE

WMGRINPNSGGINYAQKFQGRVTMTRDTSISTAYMELSRLRSDDT

AVYYCARGRTEYIVVAEGFDYWGQGTLVTVSSGGGGSGGGGSGGG

GSDVVMTQSPPSLLVTLGQPASISCRSSQSLLHSSGNTYLNWLLQ

RPGQSPQPLIYLVSKLESGVPDRFSGSGSGTDFTLKISGVEAEDV

GVYYCMQFTHYPYTFGQGTKLEIK.

In some embodiments, the CAR is at least 85%, at least 90%, at least 95%, at least 98%, at least 99%, or 100% identical to an amino acid sequence of any one of the following sequences.

(SEQ ID NO: 754)
METDTLLLWVLLLWVPGSTGDVVLTQTPPTLLATIGQSVSISCRSSQSLLHSSGNTYLNWLLQR

TGQSPQPLIYLVSKLESGVPNRFSGSGSGTDFTLKISGVEAEDLGVYYCMQFTHYPYTFGAGTK

LELKGGGGSGGGGSGGGGSEVQLQQSGPELQRPGASVKLSCKASGYIFTEYYMYWVKQRPKQQL

ELVGRIDPEDGSIDYVEKFKKKATLTADTSSNTAYMQLSSLTSEDTATYFCARGKENYRFAYWG

QGTLVTVSSSDPTTTPAPRPPTPAPTIASQPLSLRPEACRPAAGGAVHTRGLDFACDIYIWAPL

AGTCGVLLLSLVITLYCTKRKKQRSRRNDEELETRAHRVATEERGRKPHQIPASTPQNPATSQH

PPPPPGHRSQAPSHRPPPPGHRVQHQPQKRPPAPSGTQVHQQKGPPLPRPRVQPKPPHGAAENS

LSPSSNRVKFSRSADAPAYQQGQNQLYNELNLGRREEYDVLDKRRGRDPEMGGKPRRKNPQEGL

YNELQKDKMAEAYSEIGMKGERRRGKGHDGLYQGLSTATKDTYDALHMQALPPR;

(SEQ ID NO: 755)
METDTLLLWVLLLWVPGSTGEVQLQQSGPELQRPGASVKLSCKASGYIFTEYYMYWVKQRPKQQ

LELVGRIDPEDGSIDYVEKFKKKATLTADTSSNTAYMQLSSLTSEDTATYFCARGKENYRFAYW

GQGTLVTVSSGGGGSGGGGSGGGGSDVVLTQTPPTLLATIGQSVSISCRSSQSLLHSSGNTYLN

WLLQRTGQSPQPLIYLVSKLESGVPNRFSGSGSGTDFTLKISGVEAEDLGVYYCMQFTHYPYTF

GAGTKLELKSDPTTTPAPRPPTPAPTIASQPLSLRPEACRPAAGGAVHTRGLDFACDIYIWAPL

AGTCGVLLLSLVITLYCTKRKKQRSRRNDEELETRAHRVATEERGRKPHQIPASTPQNPATSQH

PPPPPGHRSQAPSHRPPPPGHRVQHQPQKRPPAPSGTQVHQQKGPPLPRPRVQPKPPHGAAENS

LSPSSNRVKFSRSADAPAYQQGQNQLYNELNLGRREEYDVLDKRRGRDPEMGGKPRRKNPQEGL

YNELQKDKMAEAYSEIGMKGERRRGKGHDGLYQGLSTATKDTYDALHMQALPPR;

(SEQ ID NO: 756)
METDTLLLWVLLLWVPGSTGDVVMTQSPPSLLVTLGQPASISCRSSQSLLHSSGNTYLNWLLQR

PGQSPQPLIYLVSKLESGVPDRFSGSGSGTDFTLKISGVEAEDVGVYYCMQFTHYPYTFGQGTK

LEIKGGGGSGGGGSGGGGSQVQLVQSGAEVKKPGASVKVSCKASGYTFTEYYMYWVRQAPGQGL

ELMGRIDPEDGSIDYVEKFKKKVTLTADTSSSTAYMELSSLISDDTAVYYCARGKENYRFAYWG

QGTLVTVSSSDPTTTPAPRPPTPAPTIASQPLSLRPEACRPAAGGAVHTRGLDFACDIYIWAPL

AGTCGVLLLSLVITLYCTKRKKQRSRRNDEELETRAHRVATEERGRKPHQIPASTPQNPATSQH

PPPPPGHRSQAPSHRPPPPGHRVQHQPQKRPPAPSGTQVHQQKGPPLPRPRVQPKPPHGAAENS

LSPSSNRVKFSRSADAPAYQQGQNQLYNELNLGRREEYDVLDKRRGRDPEMGGKPRRKNPQEGL

YNELQKDKMAEAYSEIGMKGERRRGKGHDGLYQGLSTATKDTYDALHMQALPPR;

-continued (SEQ ID NO: 757)

METDTLLLWVLLLWVPGSTGQVQLVQSGAEVKKPGASVKVSCKASGYTFTEYYMYWVRQAPGQG

LELMGRIDPEDGSIDYVEKFKKKVTLTADTSSSTAYMELSSLTSDDTAVYYCARGKENYRFAYW

GQGTLVTVSSGGGGSGGGGSGGGGSDVVMTQSPPSLLVTLGQPASISCRSSQSLLHSSGNTYLN

WLLQRPGQSPQPLIYLVSKLESGVPDRESGSGSGTDFTLKISGVEAEDVGVYYCMQFTHYPYTE

GQGTKLEIKSDPTTTPAPRPPTPAPTIASQPLSLRPEACRPAAGGAVHTRGLDFACDIYIWAPL

AGTCGVLLLSLVITLYCTKRKKQRSRRNDEELETRAHRVATEERGRKPHQIPASTPQNPATSQH

PPPPPGHRSQAPSHRPPPPGHRVQHQPQKRPPAPSGTQVHQQKGPPLPRPRVQPKPPHGAAENS

LSPSSNRVKFSRSADAPAYQQGQNQLYNELNLGRREEYDVLDKRRGRDPEMGGKPRRKNPQEGL

YNELQKDKMAEAYSEIGMKGERRRGKGHDGLYQGLSTATKDTYDALHMQALPPR;

(SEQ ID NO: 758)

METDTLLLWVLLLWVPGSTGDVVMTQSPPSLLVTLGQPASISCRSSQSLLHSSGNTYLNWLLQR

PGQSPQPLIYLVSKLESGVPDRFSGSGSGTDFTLKISGVEAEDVGVYYCMQFTHYPYTFGQGTK

LEIKGGGGSGGGGSGGGGSQVQLVQSGAEVKKPGASVKVSCKASGYTFTGYYMHWVRQAPGQGL

EWMGRINPNSGGTNYAQKFQGRVTMIRDTSISTAYMELSRLRSDDTAVYYCARGRTEYIVVAEG

FDYWGQGTLVTVSSSDPTTTPAPRPPTPAPTIASQPLSLRPEACRPAAGGAVHTRGLDFACDIY

IWAPLAGTCGVLLLSLVITLYCTKRKKQRSRRNDEELETRAHRVATEERGRKPHQIPASTPQNP

ATSQHPPPPPGHRSQAPSHRPPPPGHRVQHQPQKRPPAPSGTQVHQQKGPPLPRPRVQPKPPHG

AAENSLSPSSNRVKFSRSADAPAYQQGQNQLYNELNLGRREEYDVLDKRRGRDPEMGGKPRRKN

PQEGLYNELQKDKMAEAYSEIGMKGERRRGKGHDGLYQGLSTATKDTYDALHMQALPPR;

(SEQ ID NO: 759)

METDTLLLWVLLLWVPGSTGQVQLVQSGAEVKKPGASVKVSCKASGYTFTGYYMHWVRQAPGQG

LEWMGRINPNSGGTNYAQKFQGRVTMTRDTSISTAYMELSRLRSDDTAVYYCARGRTEYIVVAE

GFDYWGQGTLVTVSSGGGGSGGGGSGGGGSDVVMTQSPPSLLVTLGQPASISCRSSQSLLHSSG

NTYLNWLLQRPGQSPQPLIYLVSKLESGVPDRESGSGSGTDFTLKISGVEAEDVGVYYCMQFTH

YPYTFGQGTKLEIKSDPTTTPAPRPPTPAPTIASQPLSLRPEACRPAAGGAVHTRGLDFACDIY

IWAPLAGTCGVLLLSLVITLYCTKRKKQRSRRNDEELETRAHRVATEERGRKPHQIPASTPQNP

ATSQHPPPPPGHRSQAPSHRPPPPGHRVQHQPQKRPPAPSGTQVHQQKGPPLPRPRVQPKPPHG

AAENSLSPSSNRVKFSRSADAPAYQQGQNQLYNELNLGRREEYDVLDKRRGRDPEMGGKPRRKN

PQEGLYNELQKDKMAEAYSEIGMKGERRRGKGHDGLYQGLSTATKDTYDALHMQALPPR;

(SEQ ID NO: 761)

METDTLLLWVLLLWVPGSTGDVVLTQTPPTLLATIGQSVSISCRSSQSLLHSSGNTYLNWLLQR

TGQSPQPLIYLVSKLESGVPNRESGSGSGTDFTLKISGVEAEDLGVYYCMQFTHYPYTFGAGTK

LELKGGGGSGGGGSGGGGSEVQLQQSGPELQRPGASVKLSCKASGYIFTEYYMYWVKQRPKQQL

ELVGRIDPEDGSIDYVEKFKKKATLTADTSSNTAYMQLSSLTSEDTATYFCARGKENYRFAYWG

QGTLVTVSSSDPTTTPAPRPPTPAPTIASQPLSLRPEACRPAAGGAVHTRGLDFACDIYIWAPL

AGTCGVLLLSLVITLYCRSKRSRLLHSDYMNMTPRRPGPTRKHYQPYAPPRDFAAYRSRVKESR

SADAPAYQQGQNQLYNELNLGRREEYDVLDKRRGRDPEMGGKPRRKNPQEGLYNELQKDKMAEA

YSEIGMKGERRRGKGHDGLYQGLSTATKDTYDALHMQALPPR;

(SEQ ID NO: 762)

METDTLLLWVLLLWVPGSTGEVQLQQSGPELQRPGASVKLSCKASGYIFTEYYMYWVKQRPKQQ

LELVGRIDPEDGSIDYVEKFKKKATLTADTSSNTAYMQLSSLTSEDTATYFCARGKFNYRFAYW

-continued

GQGTLVTVSSGGGGSGGGGSGGGGSDVVLTQTPPTLLATIGQSVSISCRSSQSLLHSSGNTYLN
WLLQRTGQSPQPLIYLVSKLESGVPNRFSGSGSGTDFTLKISGVEAEDLGVYYCMQFTHYPYTE
GAGTKLELKSDPTTTPAPRPPTPAPTIASQPLSLRPEACRPAAGGAVHTRGLDFACDIYIWAPL
AGTCGVLLLSLVITLYCRSKRSRLLHSDYMNMTPRRPGPTRKHYQPYAPPRDFAAYRSRVKESR
SADAPAYQQGQNQLYNELNLGRREEYDVLDKRRGRDPEMGGKPRRKNPQEGLYNELQKDKMAEA
YSEIGMKGERRRGKGHDGLYQGLSTATKDTYDALHMQALPPR;

(SEQ ID NO: 763)
METDTLLLWVLLLWVPGSTGDVVMTQSPPSLLVTLGQPASISCRSSQSLLHSSGNTYLNWLLQR
PGQSPQPLIYLVSKLESGVPDRFSGSGSGTDFTLKISGVEAEDVGVYYCMQFTHYPYTFGQGTK
LEIKGGGGSGGGGSGGGGSQVQLVQSGAEVKKPGASVKVSCKASGYTFTEYYMYWVRQAPGQGL
ELMGRIDPEDGSIDYVEKFKKKVTLTADTSSSTAYMELSSLTSDDTAVYYCARGKENYRFAYWG
QGTLVTVSSSDPTTTPAPRPPTPAPTIASQPLSLRPEACRPAAGGAVHTRGLDFACDIYIWAPL
AGTCGVLLLSLVITLYCRSKRSRLLHSDYMNMTPRRPGPTRKHYQPYAPPRDFAAYRSRVKESR
SADAPAYQQGQNQLYNELNLGRREEYDVLDKRRGRDPEMGGKPRRKNPQEGLYNELQKDKMAEA
YSEIGMKGERRRGKGHDGLYQGLSTATKDTYDALHMQALPPR;

(SEQ ID NO: 764)
METDTLLLWVLLLWVPGSTGQVQLVQSGAEVKKPGASVKVSCKASGYTFTEYYMYWVRQAPGQG
LELMGRIDPEDGSIDYVEKFKKKVTLTADTSSSTAYMELSSLTSDDTAVYYCARGKENYRFAYW
GQGTLVTVSSGGGGSGGGGSGGGGSDVVMTQSPPSLLVTLGQPASISCRSSQSLLHSSGNTYLN
WLLQRPGQSPQPLIYLVSKLESGVPDRESGSGSGTDFTLKISGVEAEDVGVYYCMQFTHYPYTF
GQGTKLEIKSDPTTTPAPRPPTPAPTIASQPLSLRPEACRPAAGGAVHTRGLDFACDIYIWAPL
AGTCGVLLLSLVITLYCRSKRSRLLHSDYMNMTPRRPGPTRKHYQPYAPPRDFAAYRSRVKESR
SADAPAYQQGQNQLYNELNLGRREEYDVLDKRRGRDPEMGGKPRRKNPQEGLYNELQKDKMAEA
YSEIGMKGERRRGKGHDGLYQGLSTATKDTYDALHMQALPPRV;

(SEQ ID NO: 765)
METDTLLLWVLLLWVPGSTGDVVMTQSPPSLLVTLGQPASISCRSSQSLLHSSGNTYLNWLLQR
PGQSPQPLIYLVSKLESGVPDRFSGSGSGTDFTLKISGVEAEDVGVYYCMQFTHYPYTFGQGTK
LEIKGGGGSGGGGSGGGGSQVQLVQSGAEVKKPGASVKVSCKASGYTFTGYYMHWVRQAPGQGL
EWMGRINPNSGGTNYAQKFQGRVTMTRDTSISTAYMELSRLRSDDTAVYYCARGRTEYIVVAEG
FDYWGQGTLVTVSSSDPTTTPAPRPPTPAPTIASQPLSLRPEACRPAAGGAVHTRGLDFACDIY
IWAPLAGTCGVLLLSLVITLYCRSKRSRLLHSDYMNMTPRRPGPTRKHYQPYAPPRDFAAYRSR
VKFSRSADAPAYQQGQNQLYNELNLGRREEYDVLDKRRGRDPEMGGKPRRKNPQEGLYNELQKD
KMAEAYSEIGMKGERRRGKGHDGLYQGLSTATKDTYDALHMQALPPR;
and (SEQ ID NO: 766)
ETDTLLLWVLLLWVPGSTGQVQLVQSGAEVKKPGASVKVSCKASGYTFTGYYMHWVRQAPGQG
LEWMGRINPNSGGTNYAQKFQGRVTMTRDTSISTAYMELSRLRSDDTAVYYCARGRTEYIVVAE
GFDYWGQGTLVTVSSGGGGSGGGGSGGGGSDVVMTQSPPSLLVTLGQPASISCRSSQSLLHSSG
NTYLNWLLQRPGQSPQPLIYLVSKLESGVPDRESGSGSGTDFTLKISGVEAEDVGVYYCMQFTH
YPYTFGQGTKLEIKSDPTTTPAPRPPTPAPTIASQPLSLRPEACRPAAGGAVHTRGLDFACDIY
IWAPLAGTCGVLLLSLVITLYCRSKRSRLLHSDYMNMTPRRPGPTRKHYQPYAPPRDFAAYRSR
VKFSRSADAPAYQQGQNQLYNELNLGRREEYDVLDKRRGRDPEMGGKPRRKNPQEGLYNELQKD
KMAEAYSEIGMKGERRRGKGHDGLYQGLSTATKDTYDALHMQALPPR.

In another aspect, the invention provides a modified immune cell comprising: any of the chimeric antigen receptors as provided herein; and one or more mutations in the genome of the modified immune cell that inactivates an endogenous CD2 gene of the modified immune cell. In some embodiments, the modified immune cell further includes one or more mutations in at least one additional gene sequence or regulatory element thereof. In some embodiments, the one or more mutations is at least one single target nucleobase modification. In some embodiments, the at least one single target nucleobase modification is generated by one or more base editors. In some embodiments, the one or more base editors is a CBE and/or ABE. In some embodiments, the single target nucleobase modification reduces or eliminates expression and/or function as compared to a control cell without the modification. In some embodiments, expression and/or function is reduced by at least 50%, in at least 60%, in at least 70%, in at least 80%, in at least 90%, or in at least 100% as compared to a control cell without the modification. In some embodiments, the at least one additional gene sequence comprises a checkpoint inhibitor gene sequence, an immune response regulation gene sequence, and/or an immunogenic gene sequence. In some embodiments, the at least one additional gene sequence comprises a check point inhibitor gene sequence. In some embodiments, the check point inhibitor gene sequence comprises a PDCD1/PD-1 gene sequence. In some embodiments, the at least one additional gene sequence comprises a TRAC gene sequence. In some embodiments, the at least one additional gene sequence comprises a T cell marker gene sequence. In some embodiments, the at least one additional gene sequence comprises a CD52 gene sequence. In some embodiments, the at least one additional gene sequence comprises a TRAC gene sequence, a PDCD1/PD-1 gene sequence, a B2M gene sequence, a CIITA gene sequence, a TRBC1 gene sequence, a TRBC2 gene sequence, and/or a CD52 gene sequence.

In yet another aspect, the invention provides a modified immune cell comprising: any of the chimeric antigen receptors as provided herein; and at least one single target nucleobase modification in each one of a CD2 gene sequence, a TRAC gene sequence, a PDCD1/PD-1 gene sequence, a B2M gene sequence, a CIITA gene sequence, a TRBC1 gene sequence, a TRBC2 gene sequence, and/or a CD52 gene sequence, or a regulatory element thereof, in the modified immune cell to inactivate expression of each of the gene sequences. In some embodiments, the modified immune cell exhibits fratricide resistance and increased anti-neoplasia activity as compared to a control cell of a same type without the modification. In some embodiments, the immune cell is modified ex vivo. In some embodiments, the modified immune cell comprises no detectable translocations. In some embodiments, the immune cell comprises less than 1% of indels. In some embodiments, the immune cell comprises less than 5% of non-target edits. In some embodiments, the immune cell comprises less than 5% of off-target edits. In some embodiments, the at least one single target nucleobase modification is in an exon. In some embodiments, the at least one single target nucleobase modification is within an exon 2, an exon 3, an exon 4, or an exon 5 of the CD2 gene sequence. In some embodiments, the at least one single target nucleobase modification introduces a premature stop codon. In some embodiments, the at least one single target nucleobase modification introduces a premature stop codon within exon 2, an exon 3, an exon 4, or an exon 5 of the CD2 gene sequence. In some embodiments, the at least one single target nucleobase modification is in a splice donor site or a splice acceptor site. In some embodiments, the at least one single target nucleobase modification is in an exon 3 splice donor site of the CD2 gene sequence. In some embodiments, the at least one single target nucleobase modification is generated by one or more base editors. In some embodiments, the one or more base editors is a CBE and/or ABE. In some embodiments, the immune cell is a mammalian cell. In some embodiments, the immune cell is a human cell. In some embodiments, the immune cell is a cytotoxic T cell, a regulatory T cell, a T helper cell, a dendritic cell, a B cell, or a NK cell. In some embodiments, the immune cell is derived from a single human donor. In some embodiments, the immune cell is obtained from a healthy subject.

In one aspect, the invention provides a population of modified immune cells, wherein a plurality of the population of cells includes any of the modified immune cells as provided herein.

In another aspect, the invention provides a population of modified immune cells, wherein a plurality of the population of cells comprise a. any of the chimeric antigen receptors as provided herein, and b. one or more mutations in the genome of the modified immune cell that inactivates an endogenous CD2 gene of the modified immune cell. In some embodiments, the population of modified immune cells further includes one or more mutations in at least one additional gene sequence or regulatory element thereof. In some embodiments, the one or more mutations is at least one single target nucleobase modification. In some embodiments, the at least one single target nucleobase modification reduces or eliminates expression and/or function as compared to a control cell without the modification. In some embodiments, expression and/or function is reduced in at least 50%, in at least 60%, in at least 70%, in at least 80%, in at least 90%, or in at least 100% of the population of modified immune cells. In some embodiments, at least 50%, at least 60%, at least 70%, at least 80%, at least 90%, or at least 100% of the population of modified immune cells comprises the one or more mutations. In some embodiments, the at least one additional gene sequence comprises a checkpoint inhibitor gene sequence, an immune response regulation gene sequence, and/or an immunogenic gene sequence. In some embodiments, the at least one additional gene sequence comprises a check point inhibitor gene sequence. In some embodiments, the check point inhibitor gene sequence comprises a PDCD1/PD-1 gene sequence. In some embodiments, the at least one additional gene sequence comprises a TRAC gene sequence. In some embodiments, the at least one additional gene sequence comprises a T cell marker gene sequence. In some embodiments, the at least one additional gene sequence comprises a CD52 gene sequence. In some embodiments, the at least one additional gene sequence comprises a TRAC gene sequence, a PDCD1/PD-1 gene sequence, a B2M gene sequence, a CIITA gene sequence, a TRBC1 gene sequence, a TRBC2 gene sequence, and/or a CD52 gene sequence.

In yet another aspect, the invention provides a population of modified immune cells comprising: any of the chimeric antigen receptors as provided herein; and at least one single target nucleobase modification in each one of a CD2 gene sequence, a TRAC gene sequence, a PDCD1/PD-1 gene sequence, a B2M gene sequence, a CIITA gene sequence, a TRBC1 gene sequence, a TRBC2 gene sequence, and/or a CD52 gene sequence, or a regulatory element thereof, in the population of modified immune cells to inactivate expression of each of the gene sequences. In some embodiments, the population of modified immune cells exhibit fratricide resistance and increased anti-neoplasia activity as compared to a control cell population of a same type without the modification. In some embodiments, the population of immune cells are modified ex vivo. In some embodiments, the population of modified immune cells comprise no detectable translocations. In some embodiments, the population of modified immune cells comprise less than 1% of indels. In some embodiments, the population of modified immune cells comprise less than 5% of non-target edits.

In some embodiments, the population of modified immune cells comprise less than 5% of off-target edits. In some embodiments, the at least one single target nucleobase modification is in an exon. In some embodiments, the at least one single target nucleobase modification is within an exon 2, an exon 3, an exon 4, or an exon 5 of the CD2 gene sequence. In some embodiments, the at least one single target nucleobase modification introduces a premature stop codon. In some embodiments, the at least one single target nucleobase modification introduces a premature stop codon within exon 2, an exon 3, an exon 4, or an exon 5 of the CD2 gene sequence. In some embodiments, the at least one single target nucleobase modification is in a splice donor site or a splice acceptor site. In some embodiments, the at least one single target nucleobase modification is in an exon 3 splice donor site of the CD2 gene sequence. In some embodiments, the at least one single target nucleobase modification is generated by one or more base editors. In some embodiments, the one or more base editors is a CBE and/or ABE. In some embodiments, at least 50%, at least 60%, at least 70%, at least 80%, at least 90%, or at least 100% of the population of modified immune cells comprises the at least one single target nucleobase modification.

In some embodiments, the immune cell is a mammalian cell. In some embodiments, the immune cell is a human cell. In some embodiments, the immune cell is a cytotoxic T cell, a regulatory T cell, a T helper cell, a dendritic cell, a B cell, or a NK cell. In some embodiments, the immune cell is derived from a single human donor. In some embodiments, the immune cell is obtained from a healthy subject.

In one aspect, the invention provides a method for enriching the population of any of the modified immune cells as provided herein. In some embodiments, the method includes removing from the population of modified immune cells a) a cell that does not have an inactivated CD2 gene; and/or b) a cell expressing •/• T-cell receptor (TCR••). In some embodiments, CD2+ cells are removed by administering an anti-CD2 CAR the population of modified immune cells. In some embodiments, TCR••+ cells are removed using a TCR•• depletion column.

In another aspect, the invention provides a method for producing a fratricide-resistant modified immune cell. In some embodiments, the method includes: i) generating one or more mutations in the genome of the modified immune cell that inactivates an endogenous CD2 gene of the modified immune cell; and ii) expressing any of the chimeric antigen receptor (CAR) as provided herein in the modified immune cell.

In yet another aspect, the invention provides a method for producing a population of fratricide-resistant modified immune cells. In some embodiments, the method includes: i) generating one or more mutations in the genome of a population of modified immune cells that inactivates an endogenous CD2 gene of the population of modified immune cells; and ii) expressing any of the chimeric antigen receptors (CARs) as provided herein in the population of modified immune cells. In some embodiments, the method further includes one or more mutations in at least one additional gene sequence or regulatory element thereof. In some embodiments, the one or more mutations is at least one single target nucleobase modification. In some embodiments, the at least one single target nucleobase modification is generated by one or more base editors. In some embodiments, the one or more base editors is a CBE and/or ABE.

In some embodiments, the single target nucleobase modification reduces or eliminates expression and/or function as compared to a control cell without the modification. In some embodiments, expression and/or function is reduced by at least 50%, by at least 60%, by at least 70%, by at least 80%, by at least 90%, or by at least 100% as compared to a control cell without the modification. In some embodiments, expression and/or function is reduced in at least 50%, in at least 60%, in at least 70%, in at least 80%, in at least 90%, or in at least 100% of the population of modified immune cells. In some embodiments, the at least one additional gene sequence comprises a checkpoint inhibitor gene sequence, an immune response regulation gene sequence, and/or an immunogenic gene sequence. In some embodiments, the at least one additional gene sequence comprises a check point inhibitor gene sequence. In some embodiments, the check point inhibitor gene sequence comprises a PDCD1/PD-1 gene sequence. In some embodiments, the at least one additional gene sequence comprises a TRAC gene sequence. In some embodiments, the at least one additional gene sequence comprises a T cell marker gene sequence. In some embodiments, the at least one additional gene sequence comprises a CD52 gene sequence. In some embodiments, the at least one additional gene sequence comprises a TRAC gene sequence, a PDCD1/PD-1 gene sequence, a B2M gene sequence, a CIITA gene sequence, a TRBC1 gene sequence, a TRBC2 gene sequence, and/or a CD52 gene sequence.

In one aspect, the invention provides a method for producing a fratricide-resistant modified immune cell. In some embodiments, the method includes: i) generating one or more mutations in the genome of the modified immune cell that inactivates each one of an endogenous CD2 gene sequence, an endogenous TRAC gene, an endogenous PDCD1/PD-1 gene, a B2M gene sequence, a CIITA gene sequence, a TRBC1 gene sequence, a TRBC2 gene sequence, and/or an endogenous CD52 gene of the modified immune cell, and ii) expressing any of the chimeric antigen receptors (CARs) as provided herein in the modified immune cell.

In another aspect, the invention provides a method for producing a population of fratricide-resistant modified immune cells. In some embodiments, the method includes: i) generating one or more mutations in the genome of a population of modified immune cells that inactivates an endogenous CD2 gene sequence, an endogenous TRAC gene, an endogenous PDCD1/PD-1 gene, a B2M gene sequence, a CIITA gene sequence, a TRBC1 gene sequence, a TRBC2 gene sequence, and/or an endogenous CD52 gene of the population of modified immune cells, and ii) expressing any of the chimeric antigen receptors (CARs) as provided herein in the population of modified immune cells.

In some embodiments, the modified immune cell exhibits fratricide resistance and increased anti-neoplasia activity as compared to a control cell of a same type without the modification. In some embodiments, the immune cell is modified ex vivo. In some embodiments, the modified immune cell comprises no detectable translocations. In some embodiments, the immune cell comprises less than 1% of indels. In some embodiments, the immune cell comprises less than 5% of non-target edits. In some embodiments, the immune cell comprises less than 5% of off-target edits. In some embodiments, the single target nucleobase modification is in an exon. In some embodiments, the single target nucleobase modification is within an exon 2, an exon 3, an exon 4, or an exon 5 of the CD2 gene sequence. In some embodiments, the single target nucleobase modification introduces a premature stop codon. In some embodiments, the single target nucleobase modification introduces a premature stop codon within exon 2, an exon 3, an exon 4, or an exon 5 of the CD2 gene sequence. In some embodiments, the single target nucleobase modification is in a splice donor site or a splice acceptor site. In some embodiments, the single target nucleobase modification is in an exon 3 splice donor site of the CD2 gene sequence. In some embodiments, the CAR is expressed in the immune cell via viral transduction. In some embodiments, the CAR is expressed in the immune cell via lentiviral transduction.

In some embodiments, the step of generating one or more mutations comprises deaminating at least one single target nucleobase. In some embodiments, the deaminating is performed by a polypeptide comprising a deaminase. In some embodiments, the deaminase is associated with a nucleic acid programmable DNA binding protein (napDNAbp) to form a base editor. In some embodiments, the base editor is a CBE and/or ABE. In some embodiments, the deaminase is fused to the nucleic acid programmable DNA binding protein (napDNAbp). In some embodiments, the napDNAbp comprises a Cas9 polypeptide or a portion thereof. In some embodiments, the napDNAbp comprises a Cas9 nickase or nuclease dead Cas9. In some embodiments, the napDNAbp comprises a Cas12 polypeptide or a portion thereof. In some embodiments, the deaminase is a cytidine deaminase. In some embodiments, the single target nucleobase is a cytosine (C) and wherein the modification comprises conversion of the C to a thymine (T). In some embodiments, the deaminase is an adenosine deaminase. In some embodiments, the single target nucleobase is a adenosine (A) and wherein the modification comprises conversion of the A to a guanine (G). In some embodiments, the base editor further comprises a uracil glycosylase inhibitor. In some embodiments, the step of generating one or more mutations further comprises contacting the immune cell with the base editor and one or more guide nucleic acid sequences. In some embodiments, the one or more guide nucleic acid sequences target the napDNAbp to the CD2 gene sequence or regulatory element thereof. In some embodiments, each of the one or more guide nucleic acid sequences target the napDNAbp to the CD2 gene sequence, CD52 gene sequence, TRAC gene sequence, a B2M gene sequence, a CIITA gene sequence, a TRBC1 gene sequence, a TRBC2 gene sequence, and/or PDC1/PD-1 gene sequence, or regulatory elements thereof.

In some embodiments, the one or more guide nucleic acid sequences comprise a sequence selected from one or more spacer sequences of Table 1, Table 2A, and/or Table 2B. In some embodiments, the one or more spacer sequences are selected from the group consisting of:

(SEQ ID NO: 388)
CUUGGGUCAGGACAUCAACU;

(SEQ ID NO: 389)
CGAUGAUCAGGAUAUCUACA;

(SEQ ID NO: 390)
CACGCACCUGGACAGCUGAC;

-continued (SEQ ID NO: 391)
AAACAGAGGAGUCGGAGAAA;

(SEQ ID NO: 392)
ACACAAGUUCACCAGCAGAA;

(SEQ ID NO: 393)
GUUCAGCCAAAACCUCCCCA;

(SEQ ID NO: 394)
AUACAAGUCCAGGAGAUCUU;
and (SEQ ID NO: 395)
UUCAGCACCAGCCUCAGAAG.

In some embodiments, the base editor and one or more guide nucleic acid sequences are introduced into the immune cell via electroporation, nucleofection, viral transduction, or a combination thereof. In some embodiments, the base editor and one or more guide nucleic acid sequences are introduced into the immune cell via electroporation. In some embodiments, the immune cell is a mammalian cell. In some embodiments, the immune cell is a human cell. In some embodiments, the immune cell is a cytotoxic T cell, a regulatory T cell, a T helper cell, a dendritic cell, a B cell, or a NK cell. In some embodiments, the immune cell is derived from a single human donor. In some embodiments, the immune cell is obtained from a healthy subject.

In one aspect, the invention provides a pharmaceutical composition comprising an effective amount of any of the modified immune cells or any of the populations of modified immune cells as provided herein in a pharmaceutically acceptable excipient.

In another aspect, the invention provides a method of treating a neoplasia in a subject. In some embodiments, the method includes administering to the subject an effective amount of any of the modified immune cells, any of the populations of modified immune cells, or any of the pharmaceutical compositions as provided herein. In some embodiments, the neoplasia in the subject has been immunophenotyped. In some embodiments, the neoplasia is $CD2^+$. In some embodiments, the neoplasia is further $CD5^+$ and/or $CD7^+$. In some embodiments, the method further includes administering to the subject either simultaneously or sequentially one or more additional modified immune cells based on the immunophenotype of the neoplasia. In some embodiments, the method further includes administering to the subject either simultaneously or sequentially an effective amount of a CD5 modified immune cell and/or a CD7 modified immune cell. In some embodiments, the CD5 modified immune cell and/or CD7 modified immune cell comprises one or more mutations in at least one gene sequence or regulatory element thereof to increase fratricide resistance, anti-neoplasia activity, resistance to graft-versus-host disease (GVHD), resistance to host-versus-graft disease (HVGD), immunosuppression, or combinations thereof. In some embodiments, the immune cell is a mammalian cell. In some embodiments, the immune cell is a human cell. In some embodiments, the immune cell is a cytotoxic T cell, a regulatory T cell, a T helper cell, a dendritic cell, a B cell, or a NK cell. In some embodiments, the subject has been previously treated with lymphodepletion. In some embodiments, the lymphodepletion involves administration of cyclophosphamide, fludarabine, and/or alemtuzumab (Cy/Flu/Campath). In some embodiments, the subject is refractory to chemotherapy or has a high tumor burden. In some embodiments, the subject is subsequently treated with allogeneic hematopoietic stem cell transplantation (allo-HSCT).

In yet another aspect, the invention provides a nucleic acid encoding any of the chimeric antigen receptors (CARs) as provided herein.

In one aspect, the invention provides a kit for the treatment of a neoplasia in a subject. In some embodiments, the kit includes any of the chimeric antigen receptors (CARs), any of the modified immune cells, any of the populations of modified immune cells, any of the pharmaceutical compositions, or any of the nucleic acids as provided herein. In some embodiments, the kit further includes a base editor polypeptide or a polynucleotide encoding a base editor polypeptide, wherein the base editor polypeptide comprises a nucleic acid programmable DNA binding protein (napDNAbp) and a deaminase. In some embodiments, the napDNAbp is Cas9 or Cas12. In some embodiments, the polynucleotide encoding the base editor is a mRNA sequence. In some embodiments, the deaminase is a cytidine deaminase or an adenosine deaminase. In some embodiments, the deaminase is a cytidine deaminase. In some embodiments, the kit further includes one or more guide nucleic acid sequences. In some embodiments, the one of more guide nucleic acid sequences target CD2. In some embodiments, the one or more guide nucleic acid sequences target each one of CD2, CD52, TRAC, a B2M gene sequence, a CIITA gene sequence, a TRBC1 gene sequence, a TRBC2 gene sequence, and/or PDC1/PD-1. In some embodiments, the one or more guide nucleic acid sequences comprise a sequence selected from guide nucleic acid sequences of Table 1, Table 2A, and/or Table 2B. In some embodiments, the one or more guide nucleic acid sequences are selected from the group consisting of: CUUGGGUCAGGACAUCAACU (SEQ ID NO: 388); CGAUGAUCAGGAUAUCUACA (SEQ ID NO: 389); CACGCACCUGGACAGCUGAC (SEQ ID NO: 390); AAACAGAGGAGUCGGAGAAA (SEQ ID NO: 391); ACACAAGUUCACCAGCAGAA (SEQ ID NO: 392); GUUCAGCCAAAACCUCCCCA (SEQ ID NO: 393); AUACAAGUCCAGGAGAUCUU (SEQ ID NO: 394); and UUCAGCACCAGCCUCAGAAG (SEQ ID NO: 395).

In some embodiments, the kit further includes a CD5 modified immune cell, a population of CD5 modified immune cells, or a pharmaceutical composition comprising a CD5 modified immune cell or population of modified immune cells. In some embodiments, the kit further includes a CD7 modified immune cell, a population of CD7 modified immune cells, or a pharmaceutical composition comprising a CD7 modified immune cell or population of modified immune cells. In some embodiments, the kit further includes written instructions for the treatment of the neoplasia.

In another aspect, the invention provides any of the pharmaceutical compositions, any of the methods, or any of the kits as provided herein, wherein the neoplasia is a T- or NK-cell malignancy. In some embodiments, the T- or NK-cell malignancy is in precursor T- or NK-cells. In some embodiments, the T- or NK-cell malignancy is in mature T- or NK-cells. In some embodiments, the neoplasia is selected from the group consisting of T-cell acute lymphoblastic leukemia (T-ALL), mycosis fungoides (MF), Sézary syndrome (SS), Peripheral T/NK•cell lymphoma, Anaplastic large cell lymphoma ALK+, Primary cutaneous T•cell lymphoma, T•cell large granular lymphocytic leukemia, Angioimmunoblastic T/NK•cell lymphoma, Hepatosplenic T•cell lymphoma, Primary cutaneous CD30+lymphoproliferative disorders, Extranodal NK/T•cell lymphoma, Adult T•cell leukemia/lymphoma, T•cell prolymphocytic leukemia, Subcutaneous panniculitis•like T-cell lymphoma, Primary cutaneous gamma•delta T-cell lymphoma, Aggressive NK•cell leukemia, and Enteropathy•associated T•cell lymphoma. In some embodiments, the subject is a human subject.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

By "adenine" or "9H-Purin-6-amine" is meant a purine nucleobase with the molecular formula $C_5H_5N_5$, having the structure

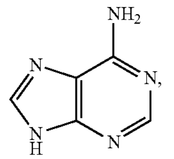

and corresponding to CAS No. 73-24-5.

By "adenosine" or "4-Amino-1-[(2R,3R,4S,5R)-3,4-dihydroxy-5-(hydroxymethyl)oxolan-2-yl]pyrimidin-2 (1H)-one" is meant an adenine molecule attached to a ribose sugar via a glycosidic bond, having the structure

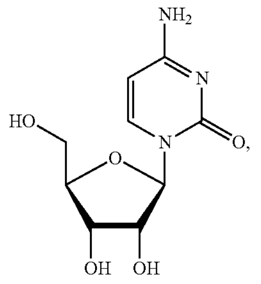

and corresponding to CAS No. 65-46-3. Its molecular formula is $C_{10}H_{13}N_5O_4$.

By "adenosine deaminase" or "adenine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism (e.g., eukaryotic, prokaryotic), including but not limited to algae, bacteria, fungi, plants, invertebrates (e.g., insects), and vertebrates (e.g., amphibians, mammals). In some embodiments, the adenosine deaminase is an adenosine deaminase variant with one or more alterations and is capable of deaminating both adenine and cytosine in a target polynucleotide (e.g., DNA, RNA). In some embodiments, the target polynucleotide is single or double stranded. In some embodiments, the adenosine deaminase variant is capable of deaminating both adenine and cytosine in DNA. In some embodiments, the adenosine deaminase variant is capable of deaminating both adenine and cytosine in single-stranded DNA. In some embodiments, the adenosine deaminase variant is capable of deaminating both adenine and cytosine in RNA.

By "adenosine deaminase activity" is meant catalyzing the deamination of adenine or adenosine to guanine in a polynucleotide. In some embodiments, an adenosine deaminase variant as provided herein maintains adenosine deaminase activity (e.g., at least about 30%, 40%, 50%, 60%, 70%, 80%, 90% or more of the activity of a reference adenosine deaminase (e.g., TadA*8.20 or TadA*8.19)).

By "Adenosine Base Editor (ABE)" is meant a base editor comprising an adenosine deaminase.

By "Adenosine Base Editor (ABE) polynucleotide" is meant a polynucleotide encoding an ABE. By "Adenosine Base Editor 8 (ABE8) polypeptide" or "ABE8" is meant a base editor as defined herein comprising an adenosine deaminase variant comprising an alteration at amino acid position 82 and/or 166 of the following reference sequence:

```
                                       (SEQ ID NO: 1)
MSEVEFSHEYWMRHALTLAKRARDEREVPVGAVLVLNNRVIGE

GWNRAIGLHDPTAHAEIMALRQGGLVMQNYRLIDATLYVTFEP

CVMCAGAMIHSRIGRVVFGVRNAKTGAAGSLMDVLHYPGMNHR

VEITEGILADECAALLCYFFRMPRQVFNAQKKAQSSTD.
```

In some embodiments, ABE8 comprises further alterations, as described herein, relative to the reference sequence.

By "Adenosine Base Editor 8 (ABE8) polynucleotide" is meant a polynucleotide encoding an ABE8 polypeptide.

"Administering" is referred to herein as providing one or more compositions described herein to a patient or a subject.

By "agent" is meant any small molecule chemical compound, antibody, nucleic acid molecule, or polypeptide, or fragments thereof.

"Allogeneic," as used herein, refers to cells of the same species that differ genetically to the cell in comparison.

By "alteration" is meant a change (increase or decrease) in the level, structure, or activity of an analyte, gene or polypeptide as detected by standard art known methods such as those described herein. As used herein, an alteration includes a 10% change in expression levels, a 25% change, a 40% change, and a 50% or greater change in expression levels. In some embodiments, an alteration includes an insertion, deletion, or substitution of a nucleobase or amino acid.

By "ameliorate" is meant decrease, suppress, attenuate, diminish, arrest, or stabilize the development or progression of a disease.

By "analog" is meant a molecule that is not identical, but has analogous functional or structural features. For example, a polypeptide analog retains the biological activity of a corresponding naturally-occurring polypeptide, while having certain biochemical modifications that enhance the analog's function relative to a naturally occurring polypeptide. Such biochemical modifications could increase the analog's protease resistance, membrane permeability, or half-life, without altering, for example, ligand binding. An analog may include an unnatural amino acid.

By "base editor (BE)," or "nucleobase editor polypeptide (NBE)" is meant an agent that binds a polynucleotide and has nucleobase modifying activity. In various embodiments, the base editor comprises a nucleobase modifying polypeptide (e.g., a deaminase) and a polynucleotide programmable nucleotide binding domain (e.g., Cas9 or Cpf1) in conjunction with a guide polynucleotide (e.g., guide RNA (gRNA)). Representative nucleic acid and protein sequences of base editors are provided in the Sequence Listing as SEQ ID NOs: 2-11.

By "base editing activity" is meant acting to chemically alter a base within a polynucleotide. In one embodiment, a first base is converted to a second base. In one embodiment, the base editing activity is cytidine deaminase activity, e.g., converting target C•G to T•A. In another embodiment, the base editing activity is adenosine or adenine deaminase activity, e.g., converting A•T to G•C.

The term "base editor system" refers to an intermolecular complex for editing a nucleobase of a target nucleotide sequence. In various embodiments, the base editor (BE) system comprises (1) a polynucleotide programmable nucleotide binding domain, a deaminase domain (e.g., cytidine deaminase or adenosine deaminase) for deaminating nucleobases in the target nucleotide sequence; and (2) one or more guide polynucleotides (e.g., guide RNA) in conjunction with the polynucleotide programmable nucleotide binding domain. In various embodiments, the base editor (BE) system comprises a nucleobase editor domain selected from an adenosine deaminase or a cytidine deaminase, and a domain having nucleic acid sequence specific binding activity. In some embodiments, the base editor system comprises (1) a base editor (BE) comprising a polynucleotide programmable DNA binding domain and a deaminase domain for deaminating one or more nucleobases in a target nucleotide sequence; and (2) one or more guide RNAs in conjunction with the polynucleotide programmable DNA binding domain. In some embodiments, the polynucleotide programmable nucleotide binding domain is a polynucleotide programmable DNA binding domain. In some embodiments, the base editor is a cytidine base editor (CBE). In some embodiments, the base editor is an adenine or adenosine base editor (ABE). In some embodiments, the base editor is an adenine or adenosine base editor (ABE) or a cytidine or cytosine base editor (CBE).

By "beta-2 microglobulin (B2M) polypeptide" is meant a protein having at least about 85% amino acid sequence identity to UniProt Accession No. P61769, provided below, or a fragment thereof and having immunomodulatory activity.

```
>sp|P61769|B2MG_HUMAN Beta-2-microglobulin
OS = Homo sapiens
OX = 9606 GN = B2M PE = 1 SV = 1
                                    (SEQ ID NO: 728)
MSRSVALAVLALLSLSGLEAIQRTPKIQVYSRHPAENGKSNFL

NCYVSGFHPSDIEVDLLKNGERIEKVEHSDLSFSKDWSFYLLY

YTEFTPTEKDEYACRVNHVTLSQPKIVKWDRDM.
```

By "beta-2-microglobulin (B2M) polynucleotide" is meant a nucleic acid molecule encoding a B2M polypeptide. The beta-2-microglobulin gene encodes a serum protein associated with the major histocompatibility complex. B2M is involved in non-self recognition by host CD8+ T cells. An exemplary B2M polynucleotide sequence is provided below.

>DQ217933.1 *Homo sapiens* beta-2-microglobin (B2M) gene, complete cds
(SEQ ID NO: 729)

CATGTCATAAATGGTAAGTCCAAGAAAAATACAGGTATTCCCCCCCAAAGAAAACTGTAAAATC

GACTTTTTTCTATCTGTACTGTTTTTTATTGGTTTTTAAATTGGTTTTCCAAGTGAGTAAATCA

GAATCTATCTGTAATGGATTTTAAATTTAGTGTTTCTCTGTGATGTAGTAAACAAGAAACTAGA

GGCAAAAATAGCCCTGTCCCTTGCTAAACTTCTAAGGCACTTTTCTAGTACAACTCAACACTAA

CATTTCAGGCCTTTAGTGCCTTATATGAGTTTTTAAAAGGGGGAAAAGGGAGGGAGCAAGAGTG

TCTTAACTCATACATTTAGGCATAACAATTATTCTCATATTTTAGTTATTGAGAGGGCTGGTAG

AAAAACTAGGTAAATAATATTAATAATTATAGCGCTTATTAAACACTACAGAACACTTACTATG

TACCAGGCATTGTGGGAGGCTCTCTCTTGTGCATTATCTCATTTCATTAGGTCCATGGAGAGTA

TTGCATTTTCTTAGTTTAGGCATGGCCTCCACAATAAAGATTATCAAAAGCCTAAAAATATGTA

AAAGAAACCTAGAAGTTATTTGTTGTGCTCCTTGGGGAAGCTAGGCAAATCCTTTCAACTGAAA

ACCATGGTGACTTCCAAGATCTCTGCCCCTCCCCATCGCCATGGTCCACTTCCTCTTCTCACTG

TTCCTCTTAGAAAAGATCTGTGGACTCCACCACCACGAAATGGCGGCACCTTATTTATGGTCAC

TTTAGAGGGTAGGTTTTCTTAATGGGTCTGCCTGTCATGTTTAACGTCCTTGGCTGGGTCCAAG

GCAGATGCAGTCCAAACTCTCACTAAAATTGCCGAGCCCTTTGTCTTCCAGTGTCTAAAATATT

AATGTCAATGGAATCAGGCCAGAGTTTGAATTCTAGTCTCTTAGCCTTTGTTTCCCCTGTCCAT

AAAATGAATGGGGGTAATTCTTTCCTCCTACAGTTTATTTATATATTCACTAATTCATTCATTC

ATCCATCCATTCGTTCATTCGGTTTACTGAGTACCTACTATGTGCCAGCCCCTGTTCTAGGGTG

GAAACTAAGAGAATGATGTACCTAGAGGGCGCTGGAAGCTCTAAAGCCCTAGCAGTTACTGCTT

TTACTATTAGTGGTCGTTTTTTTCTCCCCCCCGCCCCCCGACAAATCAACAGAACAAAGAAAAT

TACCTAAACAGCAAGGACATAGGGAGGAACTTCTTGGCACAGAACTTTCCAAACACTTTTTCCT

GAAGGGATACAAGAAGCAAGAAAGGTACTCTTTCACTAGGACCTTCTCTGAGCTGTCCTCAGGA

TGCTTTTGGGACTATTTTTCTTACCCAGAGAATGGAGAAACCCTGCAGGGAATTCCCAAGCTGT

AGTTATAAACAGAAGTTCTCCTTCTGCTAGGTAGCATTCAAAGATCTTAATCTTCTGGGTTTCC

GTTTTCTCGAATGAAAAATGCAGGTCCGAGCAGTTAACTGGCTGGGGCACCATTAGCAAGTCAC

TTAGCATCTCTGGGGCCAGTCTGCAAAGCGAGGGGGCAGCCTTAATGTGCCTCCAGCCTGAAGT

CCTAGAATGAGCGCCCGGTGTCCCAAGCTGGGGCGCGCACCCCAGATCGGAGGGCGCCGATGTA

CAGACAGCAAACTCACCCAGTCTAGTGCATGCCTTCTTAAACATCACGAGACTCTAAGAAAAGG

AAACTGAAAACGGGAAAGTCCCTCTCTCTAACCTGGCACTGCGTCGCTGGCTTGGAGACAGGTG

ACGGTCCCTGCGGGCCTTGTCCTGATTGGCTGGGCACGCGTTTAATATAAGTGGAGGCGTCGCG

CTGGCGGGCATTCCTGAAGCTGACAGCATTCGGGCCGAGATGTCTCGCTCCGTGGCCTTAGCTG

TGCTCGCGCTACTCTCTCTTTCTGGCCTGGAGGCTATCCAGCGTGAGTCTCTCCTACCCTCCCG

CTCTGGTCCTTCCTCTCCCGCTCTGCACCCTCTGTGGCCCTCGCTGTGCTCTCTCGCTCCGTGA

CTTCCCTTCTCCAAGTTCTCCTTGGTGGCCCGCCGTGGGGCTAGTCCAGGGCTGGATCTCGGGG

AAGCGGCGGGGTGGCCTGGGAGTGGGGAAGGGGGTGCGCACCCGGGACGCGCGCTACTTGCCCC

TTTCGGCGGGGAGCAGGGGAGACCTTTGGCCTACGGCGACGGGAGGGTCGGGACAAAGTTTAGG

GCGTCGATAAGCGTCAGAGCGCCGAGGTTGGGGGAGGGTTTCTCTTCCGCTCTTTCGCGGGGCC

TCTGGCTCCCCCAGCGCAGCTGGAGTGGGGGACGGGTAGGCTCGTCCCAAAGGCGCGGCGCTGA

GGTTTGTGAACGCGTGGAGGGGCGCTTGGGGTCTGGGGGAGGCGTCGCCCGGGTAAGCCTGTCT

GCTGCGGCTCTGCTTCCCTTAGACTGGAGAGCTGTGGACTTCGTCTAGGCGCCCGCTAAGTTCG

CATGTCCTAGCACCTCTGGGTCTATGTGGGGCCACACCGTGGGGAGGAAACAGCACGCGACGTT

-continued

TGTAGAATGCTTGGCTGTGATACAAAGCGGTTTCGAATAATTAACTTATTTGTTCCCATCACAT

GTCACTTTTAAAAAATTATAAGAACTACCCGTTATTGACATCTTTCTGTGTGCCAAGGACTTTA

TGTGCTTTGCGTCATTTAATTTTGAAAACAGTTATCTTCCGCCATAGATAACTACTATGGTTAT

CTTCTGCCTCTCACAGATGAAGAAACTAAGGCACCGAGATTTTAAGAAACTTAATTACACAGGG

GATAAATGGCAGCAATCGAGATTGAAGTCAAGCCTAACCAGGGCTTTTGCGGGAGCGCATGCCT

TTTGGCTGTAATTCGTGCATTTTTTTTAAGAAAAACGCCTGCCTTCTGCGTGAGATTCTCCAG

AGCAAACTGGGCGGCATGGGCCCTGTGGTCTTTTCGTACAGAGGGCTTCCTCTTTGGCTCTTTG

CCTGGTTGTTTCCAAGATGTACTGTGCCTCTTACTTTCGGTTTTGAAAACATGAGGGGGTTGGG

CGTGGTAGCTTACGCCTGTAATCCCAGCACTTAGGGAGGCCGAGGCGGGAGGATGGCTTGAGGT

CCGTAGTTGAGACCAGCCTGGCCAACATGGTGAAGCCTGGTCTCTACAAAAAATAATAACAAAA

ATTAGCCGGGTGTGGTGGCTCGTGCCTGTGGTCCCAGCTGCTCCGGTGGCTGAGGCGGGAGGAT

CTCTTGAGCTTAGGCTTTTGAGCTATCATGGCGCCAGTGCACTCCAGCGTGGGCAACAGAGCGA

GACCCTGTCTCTCAAAAAAGAAAAAAAAAAAAAAAGAAAGAGAAAAGAAAAGAAAGAAAGAAGT

GAAGGTTTGTCAGTCAGGGGAGCTGTAAAACCATTAATAAAGATAATCCAAGATGGTTACCAAG

ACTGTTGAGGACGCCAGAGATCTTGAGCACTTTCTAAGTACCTGGCAATACACTAAGCGCGCTC

ACCTTTTCCTCTGGCAAAACATGATCGAAAGCAGAATGTTTTGATCATGAGAAAATTGCATTTA

ATTTGAATACAATTTATTTACAACATAAAGGATAATGTATATATCACCACCATTACTGGTATTT

GCTGGTTATGTTAGATGTCATTTTAAAAAATAACAATCTGATATTTAAAAAAAAATCTTATTTT

GAAAATTTCCAAAGTAATACATGCCATGCATAGACCATTTCTGGAAGATACCACAAGAAACATG

TAATGATGATTGCCTCTGAAGGTCTATTTTCCTCCTCTGACCTGTGTGTGGGTTTTGTTTTTGT

TTTACTGTGGGCATAAATTAATTTTTCAGTTAAGTTTTGGAAGCTTAAATAACTCTCCAAAAGT

CATAAAGCCAGTAACTGGTTGAGCCCAAATTCAAACCCAGCCTGTCTGATACTTGTCCTCTTCT

TAGAAAAGATTACAGTGATGCTCTCACAAAATCTTGCCGCCTTCCCTCAAACAGAGAGTTCCAG

GCAGGATGAATCTGTGCTCTGATCCCTGAGGCATTTAATATGTTCTTATTATTAGAAGCTCAGA

TGCAAAGAGCTCTCTTAGCTTTTAATGTTATGAAAAAAATCAGGTCTTCATTAGATTCCCCAAT

CCACCTCTTGATGGGGCTAGTAGCCTTTCCTTAATGATAGGGTGTTTCTAGAGAGATATATCTG

GTCAAGGTGGCCTGGTACTCCTCCTTCTCCCCACAGCCTCCCAGACAAGGAGGAGTAGCTGCCT

TTTAGTGATCATGTACCCTGAATATAAGTGTATTTAAAAGAATTTTATACACATATATTTAGTG

TCAATCTGTATATTTAGTAGCACTAACACTTCTCTTCATTTTCAATGAAAAATATAGAGTTTAT

AATATTTTCTTCCCACTTCCCCATGGATGGTCTAGTCATGCCTCTCATTTTGGAAAGTACTGTT

TCTGAAACATTAGGCAATATATTCCCAACCTGGCTAGTTTACAGCAATCACCTGTGGATGCTAA

TTAAAACGCAAATCCCACTGTCACATGCATTACTCCATTTGATCATAATGGAAAGTATGTTCTG

TCCCATTTGCCATAGTCCTCACCTATCCCTGTTGTATTTTATCGGGTCCAACTCAACCATTTAA

GGTATTTGCCAGCTCTTGTATGCATTTAGGTTTTGTTTCTTTGTTTTTTAGCTCATGAAATTAG

GTACAAAGTCAGAGAGGGGTCTGGCATATAAAACCTCAGCAGAAATAAAGAGGTTTTGTTGTTT

GGTAAGAACATACCTTGGGTTGGTTGGGCACGGTGGCTCGTGCCTGTAATCCCAACACTTTGGG

AGGCCAAGGCAGGCTGATCACTTGAAGTTGGGAGTTCAAGACCAGCCTGGCCAACATGGTGAAA

TCCCGTCTCTACTGAAAATACAAAAATTAACCAGGCATGGTGGTGTGTGCCTGTAGTCCCAGGA

ATCACTTGAACCCAGGAGGCGGAGGTTGCAGTGAGCTGAGATCTCACCACTGCACACTGCACTC

CAGCCTGGGCAATGGAATGAGATTCCATCCCAAAAAATAAAAAAATAAAAAAATAAAGAACATA

-continued

CCTTGGGTTGATCCACTTAGGAACCTCAGATAATAACATCTGCCACGTATAGAGCAATTGCTAT

GTCCCAGGCACTCTACTAGACACTTCATACAGTTTAGAAAATCAGATGGGTGTAGATCAAGGCA

GGAGCAGGAACCAAAAAGAAAGGCATAAACATAAGAAAAAAAATGGAAGGGGTGGAAACAGAGT

ACAATAACATGAGTAATTTGATGGGGGCTATTATGAACTGAGAAATGAACTTTGAAAAGTATCT

TGGGGCCAAATCATGTAGACTCTTGAGTGATGTGTTAAGGAATGCTATGAGTGCTGAGAGGGCA

TCAGAAGTCCTTGAGAGCCTCCAGAGAAAGGCTCTTAAAAATGCAGCGCAATCTCCAGTGACAG

AAGATACTGCTAGAAATCTGCTAGAAAAAAAACAAAAAAGGCATGTATAGAGGAATTATGAGGG

AAAGATACCAAGTCACGGTTTATTCTTCAAAATGGAGGTGGCTTGTTGGGAAGGTGGAAGCTCA

TTTGGCCAGAGTGGAAATGGAATTGGGAGAAATCGATGACCAAATGTAAACACTTGGTGCCTGA

TATAGCTTGACACCAAGTTAGCCCCAAGTGAAATACCCTGGCAATATTAATGTGTCTTTTCCCG

ATATTCCTCAGGTACTCCAAAGATTCAGGTTTACTCACGTCATCCAGCAGAGAATGGAAAGTCA

AATTTCCTGAATTGCTATGTGTCTGGGTTTCATCCATCCGACATTGAAGTTGACTTACTGAAGA

ATGGAGAGAGAATTGAAAAAGTGGAGCATTCAGACTTGTCTTTCAGCAAGGACTGGTCTTTCTA

TCTCTTGTACTACACTGAATTCACCCCCACTGAAAAAGATGAGTATGCCTGCCGTGTGAACCAT

GTGACTTTGTCACAGCCCAAGATAGTTAAGTGGGGTAAGTCTTACATTCTTTTGTAAGCTGCTG

AAAGTTGTGTATGAGTAGTCATATCATAAAGCTGCTTTGATATAAAAAAGGTCTATGGCCATAC

TACCCTGAATGAGTCCCATCCCATCTGATATAAACAATCTGCATATTGGGATTGTCAGGGAATG

TTCTTAAAGATCAGATTAGTGGCACCTGCTGAGATACTGATGCACAGCATGGTTTCTGAACCAG

TAGTTTCCCTGCAGTTGAGCAGGGAGCAGCAGCAGCACTTGCACAAATACATATACACTCTTAA

CACTTCTTACCTACTGGCTTCCTCTAGCTTTTGTGGCAGCTTCAGGTATATTTAGCACTGAACG

AACATCTCAAGAAGGTATAGGCCTTTGTTTGTAAGTCCTGCTGTCCTAGCATCCTATAATCCTG

GACTTCTCCAGTACTTTCTGGCTGGATTGGTATCTGAGGCTAGTAGGAAGGGCTTGTTCCTGCT

GGGTAGCTCTAAACAATGTATTCATGGGTAGGAACAGCAGCCTATTCTGCCAGCCTTATTTCTA

ACCATTTTAGACATTTGTTAGTACATGGTATTTTAAAAGTAAAACTTAATGTCTTCCTTTTTTT

TCTCCACTGTCTTTTTCATAGATCGAGACATGTAAGCAGCATCATGGAGGTAAGTTTTTGACCT

TGAGAAAATGTTTTTGTTTCACTGTCCTGAGGACTATTTATAGACAGCTCTAACATGATAACCC

TCACTATGTGGAGAACATTGACAGAGTAACATTTTAGCAGGGAAAGAAGAATCCTACAGGGTCA

TGTTCCCTTCTCCTGTGGAGTGGCATGAAGAAGGTGTATGGCCCCAGGTATGGCCATATTACTG

ACCCTCTACAGAGAGGGCAAAGGAACTGCCAGTATGGTATTGCAGGATAAAGGCAGGTGGTTAC

CCACATTACCTGCAAGGCTTTGATCTTTCTTCTGCCATTTCCACATTGGACATCTCTGCTGAGG

AGAGAAAATGAACCACTCTTTTCCTTTGTATAATGTTGTTTTATTCTTCAGACAGAAGAGAGGA

GTTATACAGCTCTGCAGACATCCCATTCCTGTATGGGGACTGTGTTTGCCTCTTAGAGGTTCCC

AGGCCACTAGAGGAGATAAAGGGAAACAGATTGTTATAACTTGATATAATGATACTATAATAGA

TGTAACTACAAGGAGCTCCAGAAGCAAGAGAGAGGGAGGAACTTGGACTTCTCTGCATCTTTAG

TTGGAGTCCAAAGGCTTTTCAATGAAATTCTACTGCCCAGGGTACATTGATGCTGAAACCCCAT

TCAAATCTCCTGTTATATTCTAGAACAGGGAATTGATTTGGGAGAGCATCAGGAAGGTGGATGA

TCTGCCCAGTCACACTGTTAGTAAATTGTAGAGCCAGGACCTGAACTCTAATATAGTCATGTGT

TACTTAATGACGGGGACATGTTCTGAGAAATGCTTACACAAACCTAGGTGTTGTAGCCTACTAC

ACGCATAGGCTACATGGTATAGCCTATTGCTCCTAGACTACAAACCTGTACAGCCTGTTACTGT

ACTGAATACTGTGGGCAGTTGTAACACAATGGTAAGTATTTGTGTATCTAAACATAGAAGTTGC

AGTAAAAATATGCTATTTTAATCTTATGAGACCACTGTCATATATACAGTCCATCATTGACCAA

-continued

AACATCATATCAGCATTTTTCTTCTAAGATTTTGGGAGCACCAAAGGGATACACTAACAGGAT

ATACTCTTTATAATGGGTTTGGAGAACTGTCTGCAGCTACTTCTTTTAAAAAGGTGATCTACAC

AGTAGAAATTAGACAAGTTTGGTAATGAGATCTGCAATCCAAATAAAATAAATTCATTGCTAAC

CTTTTTCTTTTCTTTTCAGGTTTGAAGATGCCGCATTTGGATTGGATGAATTCCAAATTCTGCT

TGCTTGCTTTTTAATATTGATATGCTTATACACTTACACTTTATGCACAAAATGTAGGGTTATA

ATAATGTTAACATGGACATGATCTTCTTTATAATTCTACTTTGAGTGCTGTCTCCATGTTTGAT

GTATCTGAGCAGGTTGCTCCACAGGTAGCTCTAGGAGGGCTGGCAACTTAGAGGTGGGGAGCAG

AGAATTCTCTTATCCAACATCAACATCTTGGTCAGATTTGAACTCTTCAATCTCTTGCACTCAA

AGCTTGTTAAGATAGTTAAGCGTGCATAAGTTAACTTCCAATTTACATACTCTGCTTAGAATTT

GGGGGAAAATTTAGAAATATAATTGACAGGATTATTGGAAATTTGTTATAATGAATGAAACATT

TTGTCATATAAGATTCATATTTACTTCTTATACATTTGATAAAGTAAGGCATGGTTGTGGTTAA

TCTGGTTTATTTTTGTTCCACAAGTTAAATAAATCATAAAACTTGATGTGTTATCTCTTATATC

TCACTCCCACTATTACCCCTTTATTTTCAAACAGGGAAACAGTCTTCAAGTTCCACTTGGTAAA

AAATGTGAACCCCTTGTATATAGAGTTTGGCTCACAGTGTAAAGGGCCTCAGTGATTCACATTT

TCCAGATTAGGAATCTGATGCTCAAAGAAGTTAAATGGCATAGTTGGGGTGACACAGCTGTCTA

GTGGGAGGCCAGCCTTCTATATTTTAGCCAGCGTTCTTTCCTGCGGGCCAGGTCATGAGGAGTA

TGCAGACTCTAAGAGGGAGCAAAAGTATCTGAAGGATTTAATATTTTAGCAAGGAATAGATATA

CAATCATCCCTTGGTCTCCCTGGGGGATTGGTTTCAGGACCCCTTCTTGGACACCAAATCTATG

GATATTTAAGTCCCTTCTATAAAATGGTATAGTATTTGCATATAACCTATCCACATCCTCCTGT

ATACTTTAAATCATTTCTAGATTACTTGTAATACCTAATACAATGTAAATGCTATGCAAATAGT

TGTTATTGTTTAAGGAATAATGACAAGAAAAAAAAGTCTGTACATGCTCAGTAAAGACACAACC

ATCCCTTTTTTTCCCCAGTGTTTTTGATCCATGGTTTGCTGAATCCACAGATGTGGAGCCCCTG

GATACGGAAGGCCCGCTGTACTTTGAATGACAAATAACAGATTTAAA

The term “Cas9” or “Cas9 domain” refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casnl nuclease or a CRISPR (clustered regularly interspaced short palindromic repeat) associated nuclease.

By “chimeric antigen receptor” or “CAR” is meant a synthetic or engineered receptor comprising an extracellular antigen binding domain joined to one or more intracellular signaling domains (e.g., T cell signaling domain) that confers specificity for an antigen onto an immune effector cell. In some embodiments, the CAR includes a transmembrane domain.

By “chimeric antigen receptor T cell” or “CAR-T cell” is meant a T cell expressing a CAR that has antigen specificity determined by the antibody-derived targeting domain of the CAR. As used herein, “CAR-T cells” includes T cells or NK cells. As used herein, “CAR-T cells” includes cells engineered to express a CAR or a T cell receptor (TCR). In some embodiments, CAR-T cells can be T helper CD4+ and/or T effector CD8+ cells, optionally in defined proportions. Methods of making CARs (e.g., for treatment of cancer) are publicly available (see, e.g., Park et al., Trends Biotechnol., 29:550-557, 2011; Grupp et al., N Engl J Med., 368:1509-1518, 2013; Han et al., J. Hematol Oncol. 6:47, 2013; Haso et al., (2013) Blood, 121, 1165-1174; PCT Pubs. WO2012/079000, WO2013/059593; and U.S. Pub. 2012/0213783, each of which is incorporated by reference herein in its entirety).

By “class II, major histocompatibility complex, transactivator (CIITA)” is meant a protein having at least about 85% amino acid sequence identity to NCBI Accession No. NP_001273331.1 or a fragment thereof and having immunomodulatory activity. An exemplary amino acid sequence is provided below.

>NP 001273331.1 MHC class II transactivator isoform 1 [*Homo sapiens*]

(SEQ ID NO: 730)

MRCLAPRPAGSYLSEPQGSSQCATMELGPLEGGYLELLNSDADPL

CLYHFYDQMDLAGEEEIELYSEPDTDTINCDQFSRLLCDMEGDEE

TREAYANIAELDQYVFQDSQLEGLSKDIFIEHIGPDEVIGESMEM

PAEVGQKSQKRPFPEELPADLKHWKPAEPPTVVTGSLLVGPVSDC

STLPCLPLPALFNQEPASGQMRLEKTDQIPMPFSSSSLSCLNLPE

GPIQFVPTISTLPHGLWQISEAGTGVSSIFIYHGEVPQASQVPPP

SGFTVHGLPTSPDRPGSTSPFAPSATDLPSMPEPALTSRANMTEH

KTSPTQCPAAGEVSNKLPKWPEPVEQFYRSLQDTYGAEPAGPDGI

-continued

LVEVDLVQARLERSSSKSLERELATPDWAERQLAQGGLAEVLLAA

KEHRRPRETRVIAVLGKAGQGKSYWAGAVSRAWACGRIPQYDEVF

SVPCHCLNRPGDAYGLQDLLFSLGPQPLVAADEVFSHILKRPDRV

LLILDGFEELEAQDGELHSTCGPAPAEPCSLRGLLAGLFQKKLLR

GCTLLLTARPRGRLVQSLSKADALFELSGFSMEQAQAYVMRYFES

SGMTEHQDRALTLLRDRPLLLSHSHSPTLCRAVCQLSEALLELGE

DAKLPSTLTGLYVGLIGRAALDSPPGALAELAKLAWELGRRHQST

LQEDQFPSADVRTWAMAKGLVQHPPRAAESELAFPSFLLQCFLGA

LWLALSGEIKDKELPQYLALTPRKKRPYDNWLEGVPRFLAGLIFQ

PPARCLGALLGPSAAASVDRKQKVLARYLKRLQPGTLRARQLLEL

LHCAHEAEEAGIWQHVVQELPGRLSFLGTRLTPPDAHVLGKALEA

AGQDFSLDLRSTGICPSGLGSLVGLSCVTRFRAALSDTVALWESL

QQHGETKLLQAAEEKFTIEPFKAKSLKDVEDLGKLVQTQRTRSSS

EDTAGELPAVRDLKKLEFALGPVSGPQAFPKLVRILTAFSSLQHL

DLDALSENKIGDEGVSQLSATFPQLKSLETINLSQNNITDLGAYK

LAEALPSLAASLLRLSLYNNCICDVGAESLARVLPDMVSLRVMDV

QYNKFTAAGAQQLAASLRRCPHVETLAMWTPTIPFSVQEHLQQQD

SRISLR

By "class II, major histocompatibility complex, transactivator (CIITA)" is meant a nucleic acid encoding a CIITA polypeptide. An exemplary CIITA nucleic acid sequence is provided below.

>NM 001286402. 1 *Homo sapiens* class II major histocompatibility complex transactivator (CIITA), transcript variant 1, mRNA (SEQ ID NO: 731)

GGTTAGTGATGAGGCTAGTGATGAGGCTGTGTGCTTCTGAGCTGGGCATCCGAAGGCATCCTTG

GGGAAGCTGAGGGCACGAGGAGGGGCTGCCAGACTCCGGGAGCTGCTGCCTGGCTGGGATTCCT

ACACAATGCGTTGCCTGGCTCCACGCCCTGCTGGGTCCTACCTGTCAGAGCCCCAAGGCAGCTC

ACAGTGTGCCACCATGGAGTTGGGGCCCCTAGAAGGTGGCTACCTGGAGCTTCTTAACAGCGAT

GCTGACCCCCTGTGCCTCTACCACTTCTATGACCAGATGGACCTGGCTGGAGAAGAAGAGATTG

AGCTCTACTCAGAACCCGACACAGACACCATCAACTGCGACCAGTTCAGCAGGCTGTTGTGTGA

CATGGAAGGTGATGAAGAGACCAGGGAGGCTTATGCCAATATCGCGGAACTGGACCAGTATGTC

TTCCAGGACTCCCAGCTGGAGGGCCTGAGCAAGGACATTTTCATAGAGCACATAGGACCAGATG

AAGTGATCGGTGAGAGTATGGAGATGCCAGCAGAAGTTGGGCAGAAAAGTCAGAAAAGACCCTT

CCCAGAGGAGCTTCCGGCAGACCTGAAGCACTGGAAGCCAGCTGAGCCCCCCACTGTGGTGACT

GGCAGTCTCCTAGTGGGACCAGTGAGCGACTGCTCCACCCTGCCCTGCCTGCCACTGCCTGCGC

TGTTCAACCAGGAGCCAGCCTCCGGCCAGATGCGCCTGGAGAAAACCGACCAGATTCCCATGCC

TTTCTCCAGTTCCTCGTTGAGCTGCCTGAATCTCCCTGAGGGACCCATCCAGTTTGTCCCCACC

ATCTCCACTCTGCCCCATGGGCTCTGGCAAATCTCTGAGGCTGGAACAGGGGTCTCCAGTATAT

TCATCTACCATGGTGAGGTGCCCCAGGCCAGCCAAGTACCCCCTCCCAGTGGATTCACTGTCCA

CGGCCTCCCAACATCTCCAGACCGGCCAGGCTCCACCAGCCCCTTCGCTCCATCAGCCACTGAC

CTGCCCAGCATGCCTGAACCTGCCCTGACCTCCCGAGCAAACATGACAGAGCACAAGACGTCCC

CCACCCAATGCCCGGCAGCTGGAGAGGTCTCCAACAAGCTTCCAAAATGGCCTGAGCCGGTGGA

GCAGTTCTACCGCTCACTGCAGGACACGTATGGTGCCGAGCCCGCAGGCCCGGATGGCATCCTA

GTGGAGGTGGATCTGGTGCAGGCCAGGCTGGAGAGGAGCAGCAGCAAGAGCCTGGAGCGGGAAC

TGGCCACCCCGGACTGGGCAGAACGGCAGCTGGCCCAAGGAGGCCTGGCTGAGGTGCTGTTGGC

TGCCAAGGAGCACCGGCGGCCGCGTGAGACACGAGTGATTGCTGTGCTGGGCAAAGCTGGTCAG

GGCAAGAGCTATTGGGCTGGGGCAGTGAGCCGGGCCTGGGCTTGTGGCCGGCTTCCCCAGTACG

ACTTTGTCTTCTCTGTCCCCTGCCATTGCTTGAACCGTCCGGGGGATGCCTATGGCCTGCAGGA

TCTGCTCTTCTCCCTGGGCCCACAGCCACTCGTGGCGGCCGATGAGGTTTTCAGCCACATCTTG

AAGAGACCTGACCGCGTTCTGCTCATCCTAGACGGCTTCGAGGAGCTGGAAGCGCAAGATGGCT

TCCTGCACAGCACGTGCGGACCGGCACCGGCGGAGCCCTGCTCCCTCCGGGGGCTGCTGGCCGG

-continued

CCTTTTCCAGAAGAAGCTGCTCCGAGGTTGCACCCTCCTCCTCACAGCCCGGCCCCGGGGCCGC

CTGGTCCAGAGCCTGAGCAAGGCCGACGCCCTATTTGAGCTGTCCGGCTTCTCCATGGAGCAGG

CCCAGGCATACGTGATGCGCTACTTTGAGAGCTCAGGGATGACAGAGCACCAAGACAGAGCCCT

GACGCTCCTCCGGGACCGGCCACTTCTTCTCAGTCACAGCCACAGCCCTACTTTGTGCCGGGCA

GTGTGCCAGCTCTCAGAGGCCCTGCTGGAGCTTGGGGAGGACGCCAAGCTGCCCTCCACGCTCA

CGGGACTCTATGTCGGCCTGCTGGGCCGTGCAGCCCTCGACAGCCCCCCCGGGGCCCTGGCAGA

GCTGGCCAAGCTGGCCTGGGAGCTGGGCCGCAGACATCAAAGTACCCTACAGGAGGACCAGTTC

CCATCCGCAGACGTGAGGACCTGGGCGATGGCCAAAGGCTTAGTCCAACACCCACCGGGGGCCG

CAGAGTCCGAGCTGGCCTTCCCCAGCTTCCTCCTGCAATGCTTCCTGGGGGCCCTGTGGCTGGC

TCTGAGTGGCGAAATCAAGGACAAGGAGCTCCCGCAGTACCTAGCATTGACCCCAAGGAAGAAG

AGGCCCTATGACAACTGGCTGGAGGGCGTGCCACGCTTTCTGGCTGGGCTGATCTTCCAGCCTC

CCGCCCGCTGCCTGGGAGCCCTACTCGGGCCATCGGCGGCTGCCTCGGTGGACAGGAAGCAGAA

GGTGCTTGCGAGGTACCTGAAGCGGCTGCAGCCGGGGACACTGCGGGCGCGGCAGCTGCTGGAG

CTGCTGCACTGCGCCCACGAGGCCGAGGAGGCTGGAATTTGGCAGCACGTGGTACAGGAGCTCC

CCGGCCGCCTCTCTTTTCTGGGCACCCGCCTCACGCCTCCTGATGCACATGTACTGGGCAAGGC

CTTGGAGGCGGCGGGCCAAGACTTCTCCCTGGACCTCCGCAGCACTGGCATTTGCCCCTCTGGA

TTGGGGAGCCTCGTGGGACTCAGCTGTGTCACCCGTTTCAGGGCTGCCTTGAGCGACACGGTGG

CGCTGTGGGAGTCCCTGCAGCAGCATGGGGAGACCAAGCTACTTCAGGCAGCAGAGGAGAAGTT

CACCATCGAGCCTTTCAAAGCCAAGTCCCTGAAGGATGTGGAAGACCTGGGAAAGCTTGTGCAG

ACTCAGAGGACGAGAAGTTCCTCGGAAGACACAGCTGGGGAGCTCCCTGCTGTTCGGGACCTAA

AGAAACTGGAGTTTGCGCTGGGCCCTGTCTCAGGCCCCCAGGCTTTCCCCAAACTGGTGCGGAT

CCTCACGGCCTTTTCCTCCCTGCAGCATCTGGACCTGGATGCGCTGAGTGAGAACAAGATCGGG

GACGAGGGTGTCTCGCAGCTCTCAGCCACCTTCCCCCAGCTGAAGTCCTTGGAAACCCTCAATC

TGTCCCAGAACAACATCACTGACCTGGGTGCCTACAAACTCGCCGAGGCCCTGCCTTCGCTCGC

TGCATCCCTGCTCAGGCTAAGCTTGTACAATAACTGCATCTGCGACGTGGGAGCCGAGAGCTTG

GCTCGTGTGCTTCCGGACATGGTGTCCCTCCGGGTGATGGACGTCCAGTACAACAAGTTCACGG

CTGCCGGGGCCCAGCAGCTCGCTGCCAGCCTTCGGAGGTGTCCTCATGTGGAGACGCTGGCGAT

GTGGACGCCCACCATCCCATTCAGTGTCCAGGAACACCTGCAACAACAGGATTCACGGATCAGC

CTGAGATGATCCCAGCTGTGCTCTGGACAGGCATGTTCTCTGAGGACACTAACCACGCTGGACC

TTGAACTGGGTACTTGTGGACACAGCTCTTCTCCAGGCTGTATCCCATGAGCCTCAGCATCCTG

GCACCCGGCCCCTGCTGGTTCAGGGTTGGCCCCTGCCCGGCTGCGGAATGAACCACATCTTGCT

CTGCTGACAGACACAGGCCCGGCTCCAGGCTCCTTTAGCGCCCAGTTGGGTGGATGCCTGGTGG

CAGCTGCGGTCCACCCAGGAGCCCCGAGGCCTTCTCTGAAGGACATTGCGGACAGCCACGGCCA

GGCCAGAGGGAGTGACAGAGGCAGCCCCATTCTGCCTGCCCAGGCCCCTGCCACCCTGGGGAGA

AAGTACTTCTTTTTTTTTATTTTTAGACAGAGTCTCACTGTTGCCCAGGCTGGCGTGCAGTGGT

GCGATCTGGGTTCACTGCAACCTCCGCCTCTTGGGTTCAAGCGATTCTTCTGCTTCAGCCTCCC

GAGTAGCTGGGACTACAGGCACCCACCATCATGTCTGGCTAATTTTTCATTTTTAGTAGAGACA

GGGTTTTGCCATGTTGGCCAGGCTGGTCTCAAACTCTTGACCTCAGGTGATCCACCCACCTCAG

CCTCCCAAAGTGCTGGGATTACAAGCGTGAGCCACTGCACCGGGCCACAGAGAAAGTACTTCTC

CACCCTGCTCTCCGACCAGACACCTTGACAGGGCACACCGGGCACTCAGAAGACACTGATGGGC

-continued

AACCCCCAGCCTGCTAATTCCCCAGATTGCAACAGGCTGGGCTTCAGTGGCAGCTGCTTTTGTC

TATGGGACTCAATGCACTGACATTGTTGGCCAAAGCCAAAGCTAGGCCTGGCCAGATGCACCAG

CCCTTAGCAGGGAAACAGCTAATGGGACACTAATGGGGCGGTGAGAGGGGAACAGACTGGAAGC

ACAGCTTCATTTCCTGTGTCTTTTTTCACTACATTATAAATGTCTCTTTAATGTCACAGGCAGG

TCCAGGGTTTGAGTTCATACCCTGTTACCATTTTGGGGTACCCACTGCTCTGGTTATCTAATAT

GTAACAAGCCACCCCAAATCATAGTGGCTTAAAACAACACTCACATTTA

By "cytotoxic T-lymphocyte associated protein 4 (CTLA-4) polypeptide" is meant a protein having at least about 85% sequence identity to NCBI Accession No. EAW70354.1 or a fragment thereof. An exemplary amino acid sequence is provided below:

>EAW70354.1 cytotoxic T-lymphocyte-associated protein 4 [*Homo sapiens*] (SEQ ID NO: 732)

MACLGFORHKAQLNLATRTWPCTLLFFLLFIPVECKAMHVAQPAV

VLASSRGIASFVCEYASPGKATEVRVTVLRQADSQVTEVCAATYM

MGNELTFLDDSICTGTSSGNQVNLTIQGLRAMDIGLYICKVELMY

PPPYYLGIGNGTQIYVIDPEPCPDSDELLWILAAVSSGLFFYSEL

LTAVSLSKMLKKRSPLTTGVYVKMPPTEPECEKQFQPYFIPIN

By "cytotoxic T-lymphocyte associated protein 4 (CTLA-4) polynucleotide" is meant a nucleic acid molecule encoding a CTLA-4 polypeptide. The CTLA-4 gene encodes an immunoglobulin superfamily and encodes a protein which transmits an inhibitory signal to T cells. An exemplary CTLA-4 nucleic acid sequence is provided below.

>BC074842.2 *Homo sapiens* cytotoxic T-lymphocyte-associated protein 4, mRNA (cDNA clone MGC: 104099 IMAGE: 30915552), complete cds (SEQ ID NO: 733)

GACCTGAACACCGCTCCCATAAAGCCATGGCTTGCCTTGGATTTC

AGCGGCACAAGGCTCAGCTGAACCTGGCTACCAGGACCTGGCCCT

GCACTCTCCTGTTTTTCTTCTCTTCATCCCTGTCTTCTGCAAAG

CAATGCACGTGGCCCAGCCTGCTGTGGTACTGGCCAGCAGCCGAG

GCATCGCCAGCTTTGTGTGTGAGTATGCATCTCCAGGCAAAGCCA

CTGAGGTCCGGGTGACAGTGCTTCGGCAGGCTGACAGCCAGGTGA

CTGAAGTCTGTGCGGCAACCTACATGATGGGGAATGAGTTGACCT

TCCTAGATGATTCCATCTGCACGGGCACCTCCAGTGGAAATCAAG

TGAACCTCACTATCCAAGGACTGAGGGCCATGGACACGGGACTCT

ACATCTGCAAGGTGGAGCTCATGTACCCACCGCCATACTACCTGG

GCATAGGCAACGGAACCCAGATTTATGTAATTGATCCAGAACCGT

-continued

GCCCAGATTCTGACTTCCTCCTCTGGATCCTTGCAGCAGTTAGTT

CGGGGTTGTTTTTTTATAGCTTTCTCCTCACAGCTGTTTCTTTGA

GCAAAATGCTAAAGAAAAGAAGCCCTCTTACAACAGGGGTCTATG

TGAAAATGCCCCCAACAGAGCCAGAATGTGAAAAGCAATTTCAGC

CTTATTTTATTCCCATCAATTGAGAAACCATTATGAAGAAGAGAG

TCCATATTTCAATTTCCAAGAGCTGAGG

By "cluster of differentiation 2 (CD2) polypeptide" is meant a protein having at least about 85% amino acid sequence identity to NCBI Accession No. NP_001758.2 or fragment thereof and having immunomodulatory activity. An exemplary amino acid sequence is provided below.

>NP_001758.2 T-cell surface antigen CD2 isoform 2 precursor [*Homo sapiens*] (SEQ ID NO: 734)

1 MSFPCKFVAS FLLIFNVSSK GAVSKEITNA

LETWGALGQD INLDIPSFQM SDDIDDIKWE

61 KTSDKKKIAQ FRKEKETFKE KDTYKLEKNG

TLKIKHLKTD DQDIYKVSIY DTKGKNVLEK

121 IFDLKIQERV SKPKISWTCI NTTLTCEVMN

GTDPELNLYQ DGKHLKLSQR VITHKWTTSL

181 SAKEKCTAGN KVSKESSVEP VSCPEKGLDI

YLIIGICGGG SLIMVEVALL VEYITKRKKQ

241 RSRRNDEELE TRAHRVATEE RGRKPHQIPA

STPQNPATSQ HPPPPPGHRS QAPSHRPPPP

301 GHRVQHQPQK RPPAPSGTQV HQQKGPPLPR

PRVQPKPPHG AAENSLSPSS N

The CD2 cytoplasmic domain (amino acid residues 235-351) is shown in bold font. The architecture of an exemplary CD2 polypeptide from *Homo sapiens* is shown in FIG. 4.

By "Cluster of Differentiation 2 (CD2) polynucleotide" is meant a nucleic acid encoding a CD2 polypeptide. An exemplary CD2 nucleic acid sequence is provided below.

NM_001767.5 *Homo sapiens* CD2 molecule (CD2), transcript variant 2, mRNA (SEQ ID NO: 735)

1 agtctcactt cagttccttt tgcatgaaga gctcagaatc aaaagaggaa accaacccct 61 aagatgagct ttccatgtaa atttgtagcc agcttccttc tgattttcaa tgtttcttcc 121 aaaggtgcag tctccaaaga gattacgaat gccttggaaa cctggggtgc cttgggtcag -continued

```
 181 gacatcaact tggacattcc tagttttcaa atgagtgatg atattgacga tataaaatgg
 241 gaaaaaactt cagacaagaa aaagattgca caattcagaa aagagaaaga gactttcaag
 301 gaaaaagata catataagct atttaaaaat ggaactctga aaattaagca tctgaagacc
 361 gatgatcagg atatctacaa ggtatcaata tatgatacaa aaggaaaaaa tgtgttggaa
 421 aaaatatttg atttgaagat tcaagagagg gtctcaaaac caaagatctc ctggacttgt
 481 atcaacacaa ccctgacctg tgaggtaatg aatggaactg accccgaatt aaacctgtat
 541 caagatggga aacatctaaa actttctcag agggtcatca cacacaagtg gaccaccagc
 601 ctgagtgcaa aattcaagtg cacagcaggg aacaaagtca gcaaggaatc cagtgtcgag
 661 cctgtcagct gtccagagaa aggtctggac atctatctca tcattggcat atgtggagga
 721 ggcagcctct tgatggtctt tgtggcactg ctcgttttct atatcaccaa aaggaaaaaa
 781 cagaggagtc ggagaaatga tgaggagctg gagacaagag cccacagagt agctactgaa
 841 gaaaggggcc ggaagcccca ccaaattcca gcttcaaccc ctcagaatcc agcaacttcc
 901 caacatcctc ctccaccacc tggtcatcgt tcccaggcac ctagtcatcg tcccccgcct
 961 cctggacacc gtgttcagca ccagcctcag aagaggcctc ctgctccgtc gggcacacaa
1021 gttcaccagc agaaaggccc gcccctcccc agacctcgag ttcagccaaa acctccccat
1081 ggggcagcag aaaactcatt gtccccttcc tctaattaaa aaagatagaa actgtctttt
1141 tcaataaaaa gcactgtgga tttctgccct cctgatgtgc atatccgtac ttccatgagg
1201 tgttttctgt gtgcagaaca ttgtcacctc ctgaggctgt gggccacagc cacctctgca
1261 tcttcgaact cagccatgtg gtcaacatct ggagtttttg gtctcctcag agagctccat
1321 cacaccagta aggagaagca atataagtgt gattgcaaga atggtagagg accgagcaca
1381 gaaatcttag agatttcttg tcccctctca ggtcatgtgt agatgcgata aatcaagtga
1441 ttggtgtgcc tgggtctcac tacaagcagc ctatctgctt aagagactct ggagtttctt
1501 atgtgccctg gtggacactt gcccaccatc ctgtgagtaa aagtgaaata aaagctttga
1561 ctaga
```

By "cluster of differentiation 5 (CD5) polypeptide" is meant a protein having at least about 85% amino acid sequence identity to NCBI Accession No. NP_001333385.1 or fragment thereof and having immunomodulatory activity. An exemplary amino acid sequence is provided below.

>NP_001333385.1 T-cell surface glycoprotein CD5 isoform 2 [*Homo sapiens*]
(SEQ ID NO: 736)

```
MVCSQSWGRSSKQWEDPSQASKVCQRLNCGVPLSLGPFLVTYTPQ
SSIICYGQLGSFSNCSHSRNDMCHSLGLTCLEPQKTTPPTTRPPP
TTTPEPTAPPRLQLVAQSGGQHCAGVVEFYSGSLGGTISYEAQDK
```

-continued

```
TQDLENFLCNNLQCGSFLKHLPETEAGRAQDPGEPREHQPLPIQW
KIQNSSCTSLEHCFRKIKPQKSGRVLALLCSGFQPKVQSRLVGGS
SICEGTVEVRQGAQWAALCDSSSARSSLRWEEVCREQQCGSVNSY
RVLDAGDPTSRGLFCPHQKLSQCHELWERNSYCKKVFVTCQDPNP
AGLAAGTVASIILALVLLVVLLVVCGPLAYKKLVKKFRQKKQRQW
IGPTGMNQNMSFHRNHTATVRSHAENPTASHVDNEYSQPPRNSHL
SAYPALEGALHRSSMQPDNSSDSDYDLHGAQRL
```

By "cluster of differentiation 5 (CD5) polynucleotide" is meant a nucleic acid encoding a CD5 polypeptide. An exemplary CD5 nucleic acid sequence is provided below.

>NM_001346456.1 *Homo sapiens* CD5 molecule (CD5), transcript variant 2, mRNA
(SEQ ID NO: 737)

```
  1   gagtcttgct gatgctcccg gctgaataaa ccccttcctt ctttaacttg gtgtctgagg
 61   ggttttgtct gtggcttgtc ctgctacatt tcttggttcc ctgaccagga agcaaagtga
121   ttaacggaca gttgaggcag ccccttaggc agcttaggcc tgccttgtgg agcatccccg
181   cggggaactc tggccagctt gagcgacacg gatcctcaga gcgctcccag gtaggcaatt
```

-continued

```
241   gccccagtgg aatgcctcgt cagagcagtg catggcaggc ccctgtggag gatcaacgca

301   gtggctgaac acagggaagg aactggcact tggagtccgg acaactgaaa cttgtcgctt

361   cctgcctcgg acggctcagc tggtatgacc cagatttcca ggcaaggctc acccgttcca

421   actcgaagtg ccagggccag ctggaggtct acctcaagga cggatggcac atggtttgca

481   gccagagctg ggccggagc tccaagcagt gggaggaccc cagtcaagcg tcaaaagtct

541   gccagcggct gaactgtggg gtgcccttaa gccttggccc cttccttgtc acctacacac

601   ctcagagctc aatcatctgc tacggacaac tgggctcctt ctccaactgc agccacagca

661   gaaatgacat gtgtcactct ctgggcctga cctgcttaga accccagaag acaacacctc

721   caacgacaag gcccccgccc accacaactc cagagcccac agctcctccc aggctgcagc

781   tggtggcaca gtctggcggc cagcactgtg ccggcgtggt ggagttctac agcggcagcc

841   tgggggggtac catcagctat gaggcccagg acaagaccca ggacctggag aacttcctct

901   gcaacaacct ccagtgtggc tccttcttga agcatctgcc agagactgag gcaggcagag

961   cccaagaccc aggggagcca cgggaacacc agcccttgcc aatccaatgg aagatccaga

1021  actcaagctg tacctccctg gagcattgct tcaggaaaat caagccccag aaaagtggcc

1081  gagttcttgc cctcctttgc tcaggtttcc agcccaaggt gcagagccgt ctggtggggg

1141  gcagcagcat ctgtgaaggc accgtggagg tgcgccaggg ggctcagtgg gcagccctgt

1201  gtgacagctc ttcagccagg agctcgctgc ggtgggagga ggtgtgccgg gagcagcagt

1261  gtggcagcgt caactcctat cgagtgctgg acgctggtga cccaacatcc cgggggctct

1321  tctgtcccca tcagaagctg tcccagtgcc acgaactttg ggagagaaat tcctactgca

1381  agaaggtgtt tgtcacatgc caggatccaa accccgcagg cctggccgca ggcacggtgg

1441  caagcatcat cctggccctg gtgctcctgg tggtgctgct ggtcgtgtgc ggcccccttg

1501  cctacaagaa gctagtgaag aaattccgcc agaagaagca gcgccagtgg attggcccaa

1561  cgggaatgaa ccaaaacatg tctttccatc gcaaccacac ggcaaccgtc cgatcccatg

1621  ctgagaaccc cacagcctcc cacgtggata acgaatacag ccaacctccc aggaactccc

1681  acctgtcagc ttatccagct ctggaagggg ctctgcatcg ctcctccatg cagcctgaca

1741  actcctccga cagtgactat gatctgcatg ggctcagag gctgtaaaga actgggatcc

1801  atgagcaaaa agccgagagc cagacctgtt tgtcctgaga aaactgtccg ctcttcactt

1861  gaaatcatgt ccctatttct accccggcca gaacatggac agaggccaga agccttccgg

1921  acaggcgctg ctgccccgag tggcaggcca gctcacactc tgctgcacaa cagctcggcc

1981  gcccctccac ttgtggaagc tgtggtgggc agagccccaa aacaagcagc cttccaacta

2041  gagactcggg ggtgtctgaa gggggccccc tttccctgcc cgctggggag cggcgtctca

2101  gtgaaatcgg ctttctcctc agactctgtc cctggtaagg agtgacaagg aagctcacag

2161  ctgggcgagt gcattttgaa tagtttttg taagtagtgc ttttcctcct tcctgacaaa

2221  tcgagcgctt tggcctcttc tgtgcagcat ccacccctgc ggatccctct ggggaggaca

2281  ggaaggggac tcccggagac ctctgcagcc gtggtggtca gaggctgctc acctgagcac

2341  aaagacagct ctgcacattc accgcagctg ccagccaggg gtctgggtgg gcaccaccct

2401  gacccacagc gtcaccccac tccctctgtc ttatgactcc cctccccaac cccctcatct

2461  aaagacacct tcctttccac tggctgtcaa gcccacaggg caccagtgcc acccagggcc

2521  cggcacaaag gggcgcctag taaaccttaa ccaacttggt tttttgcttc acccagcaat

2581  taaaagtccc aagctgaggt agtttcagtc catcacagtt catcttctaa cccaagagtc

2641  agagatgggg ctggtcatgt tcctttggtt tgaataactc ccttgacgaa aacagactcc
```

-continued

```
2701  tctagtactt ggagatcttg gacgtacacc taatcccatg gggcctcggc ttccttaact
2761  gcaagtgaga agaggaggtc tacccaggag cctcgggtct gatcaaggga gaggccaggc
2821  gcagctcact gcggcggctc cctaagaagg tgaagcaaca tgggaacaca tcctaagaca
2881  ggtcctttct ccacgccatt tgatgctgta tctcctggga gcacaggcat caatggtcca
2941  agccgcataa taagtctgga agagcaaaag ggagttacta ggatatgggg tgggctgctc
3001  ccagaatctg ctcagctttc tgcccccacc aacaccctcc aaccaggcct tgccttctga
3061  gagcccccgt ggccaagccc aggtcacaga tcttcccccg accatgctgg gaatccagaa
3121  acagggaccc catttgtctt cccatatctg gtggaggtga gggggctcct caaaagggaa
3181  ctgagaggct gctcttaggg agggcaaagg ttcgggggca gccagtgtct cccatcagtg
3241  cctttttttaa taaaagctct ttcatctata gtttggccac catacagtgg cctcaaagca
3301  accatggcct acttaaaaac caaaccaaaa ataaagagtt tagttgagga gaaaaaaaaa
3361  aaaaaaaaaa aaaaaa
```

By "Cluster of Differentiation 7 (CD7) polypeptide" is meant a protein having at least about 85% amino acid sequence identity to NCBI Reference Sequence: NP_006128.1 or a fragment thereof and having immunomodulatory activity. An exemplary amino acid sequence is provided below.

>NP_006128.1 T-cell antigen CD7 precursor [*Homo sapiens*]

(SEQ ID NO: 738)

```
  1  MAGPPRLLLL PLLLALARGL PGALAAQEVQ QSPHCTTVPV GASVNITCST SGGLRGIYLR
 61  QLGPQPQDII YYEDGVVPTT DRRFRGRIDF SGSQDNLTIT MHRLQLSDTG TYTCQAITEV
121  NVYGSGTLVL VTEEQSQGWH RCSDAPPRAS ALPAPPTGSA LPDPQTASAL PDPPAASALP
181  AALAVISFLL GLGLGVACVL ARTQIKKLCS WRDKNSAACV VYEDMSHSRC NTLSSPNQYQ
```

By "Cluster of Differentiation 7 (CD7) polynucleotide" is meant a nucleic acid molecule encoding a CD7 polypeptide. An exemplary CD7 nucleic acid sequence is provided below.

>NM_006137.7 *Homo sapiens* CD7 molecule (CD7), mRNA (SEQ ID NO: 739)

```
  1  ctctctgagc tctgagcgcc tgcggtctcc tgtgtgctgc tctctgtggg gtcctgtaga
 61  cccagagagg ctcagctgca ctcgcccggc tgggagagct gggtgtgggg aacatggccg
121  ggcctccgag gctcctgctg ctgcccctgc ttctggcgct ggctcgcggc ctgcctgggg
181  ccctggctgc ccaagaggtg cagcagtctc cccactgcac gactgtcccc gtgggagcct
241  ccgtcaacat cacctgctcc accagcgggg gcctgcgtgg gatctacctg aggcagctcg
301  ggccacagcc ccaagacatc atttactacg aggacggggt ggtgcccact acggacagac
361  ggttccgggg ccgcatcgac ttctcagggt cccaggacaa cctgactatc accatgcacc
421  gcctgcagct gtcggacact ggcacctaca cctgccaggc catcacggag gtcaatgtct
481  acggctccgg caccctggtc ctggtgacag aggaacagtc ccaaggatgg cacagatgct
541  cggacgcccc accaagggcc tctgccctcc ctgccccacc gacaggctcc gccctccctg
601  acccgcagac agcctctgcc ctccctgacc cgccagcagc ctctgccctc cctgcggccc
661  tggcggtgat ctccttcctc ctcgggctgg gcctgggggt ggcgtgtgtg ctggcgagga
721  cacagataaa gaaactgtgc tcgtggcggg ataagaattc ggcggcatgt gtggtgtacg
781  aggacatgtc gcacagccgc tgcaacacgc tgtcctcccc caaccagtac cagtgaccca
```

-continued

```
 841 gtgggcccct gcacgtcccg cctgtggtcc ccccagcacc ttccctgccc caccatgccc
 901 cccaccctgc cacacccctc accctgctgt cctcccacgg ctgcagcaga gtttgaaggg
 961 cccagccgtg cccagctcca agcagacaca caggcagtgg ccaggcccca cggtgcttct
1021 cagtggacaa tgatgcctcc tccgggaagc cttccctgcc cagcccacgc cgccaccggg
1081 aggaagcctg actgtccttt ggctgcatct cccgaccatg gccaaggagg gcttttctgt
1141 gggatgggcc tgggcacgcg gccctctcct gtcagtgccg gcccacccac cagcaggccc
1201 ccaaccccca ggcagcccgg cagaggacgg gaggagacca gtcccccacc cagccgtacc
1261 agaaataaag gcttctgtgc ttcc
```

By "Cluster of Differentiation 137 (CD137) polypeptide" is meant a protein having at least about 85% amino acid sequence identity to NCBI Reference Sequence: NP_001552.2 or a fragment thereof. CD137 is also known as 4-1BB. An exemplary amino acid sequence is provided below.

```
>NP_001552.2 Tumor necrosis factor receptor superfamily member 9 precursor [Homo sapiens]
                                                                    (SEQ ID NO: 740)
  1   MGNSCYNIVA TLLLVLNFER TRSLQDPCSN CPAGTFCDNN RNQICSPCPP NSFSSAGGQR
 61   TCDICRQCKG VFRTRKECSS TSNAECDCTP GFHCLGAGCS MCEQDCKQGQ ELTKKGCKDC
121   CFGTFNDQKR GICRPWTNCS LDGKSVLVNG TKERDVVCGP SPADLSPGAS SVTPPAPARE
181   PGHSPQIISF FLALTSTALL FLLFFLTLRF SVVKRGRKKL LYIFKQPFMR PVQTTQEEDG
241   CSCRFPEEEE GGCEL
```

-

By "Cluster of Differentiation 137 (CD137) polynucleotide" is meant a nucleic acid molecule encoding a CD137 polypeptide. An exemplary CD137 nucleic acid sequence is provided below.

```
>NM_001561.6 Homo sapiens TNF receptor superfamily member 9 (TNFRSF9), mRNA
                                                                    (SEQ ID NO: 741)
   1  gcagaagcct gaagaccaag gagtggaaag ttctccggca gccctgagat ctcaagagtg
  61  acatttgtga gaccagctaa tttgattaaa attctcttgg aatcagcttt gctagtatca
 121  tacctgtgcc agatttcatc atgggaaaca gctgttacaa catagtagcc actctgttgc
 181  tggtcctcaa ctttgagagg acaagatcat tgcaggatcc ttgtagtaac tgcccagctg
 241  gtacattctg tgataataac aggaatcaga tttgcagtcc ctgtcctcca aatagtttct
 301  ccagcgcagg tggacaaagg acctgtgaca tatgcaggca gtgtaaaggt gttttcagga
 361  ccaggaagga gtgttcctcc accagcaatg cagagtgtga ctgcactcca gggtttcact
 421  gcctgggggc aggatgcagc atgtgtgaac aggattgtaa acaaggtcaa gaactgacaa
 481  aaaaaggttg taaagactgt tgctttggga catttaacga tcagaaacgt ggcatctgtc
 541  gaccctggac aaactgttct ttggatggaa agtctgtgct tgtgaatggg acgaaggaga
 601  gggacgtggt ctgtggacca tctccagccg acctctctcc gggagcatcc tctgtgaccc
 661  cgcctgcccc tgcgagagag ccaggacact ctccgcagat catctccttc tttcttgcgc
 721  tgacgtcgac tgcgttgctc ttcctgctgt tcttcctcac gctccgtttc tctgttgtta
 781  aacggggcag aaagaaactc ctgtatatat tcaaacaacc atttatgaga ccagtacaaa
 841  ctactcaaga ggaagatggc tgtagctgcc gatttccaga agaagaagaa ggaggatgtg
 901  aactgtgaaa tggaagtcaa tagggctgtt gggactttct tgaaaagaag caaggaaata
 961  tgagtcatcc gctatcacag ctttcaaaag caagaacacc atcctacata atacccagga
1021  ttcccccaac acacgttctt ttctaaatgc caatgagttg gcctttaaaa atgcaccact
```

-continued 1081 tttttttttt ttttgacagg gtctcactct gtcacccagg ctggagtgca gtggcaccac
1141 catggctctc tgcagccttg acctctggga gctcaagtga tcctcctgcc tcagtctcct
1201 gagtagctgg aactacaagg aagggccacc acacctgact aactttttttg tttttgttt
1261 ggtaaagatg gcatttcacc atgttgtaca ggctggtctc aaactcctag gttcactttg
1321 gcctcccaaa gtgctgggat tacagacatg aactgccagg cccggccaaa ataatgcacc
1381 acttttaaca gaacagacag atgaggacag agctggtgat aaaaaaaaaa aaaaaaaagc
1441 attttctaga taccacttaa caggtttgag ctagtttttt tgaaatccaa agaaaattat
1501 agtttaaatt caattacata gtccagtggt ccaactataa ttataatcaa aatcaatgca
1561 ggtttgtttt ttggtgctaa tatgacatat gacaataagc cacgaggtgc agtaagtacc
1621 cgactaaagt ttccgtgggt tctgtcatgt aacacgacat gctccaccgt caggggggag
1681 tatgagcaga gtgcctgagt ttagggtcaa ggacaaaaaa cctcaggcct ggaggaagtt
1741 ttggaaagag ttcaagtgtc tgtatatcct atggtcttct ccatcctcac accttctgcc
1801 tttgtcctgc tcccttttaa gccaggttac attctaaaaa ttcttaactt ttaacataat
1861 attttatacc aaagccaata aatgaactgc atatgatagg tatgaagtac agtgagaaaa
1921 ttaacacctg tgagctcatt gtcctaccac agcactagag tgggggccgc caaactccca
1981 tggccaaacc tggtgcacca tttgcctttg tttgtctgtt ggtttgcttg agacagtctt
2041 gctctgttgc ccaggctgga atggagtggc tattcacagg Cacaatcata gcacacttta
2101 gccttaaact cctgggctca agtgatccac ccgcctcagt ctcccaagta gctgggatta
2161 caggtgcaaa cctggcatgc ctgccattgt ttggcttatg atctaaggat agctttttaa
2221 attttattca ttttattttt ttttgagaca gtgtctcact ctgtctccca ggctggagta
2281 cagtggtaca atcttggatc accgcctccc agtttcaagt gatctccctg cctcagcctc
2341 ctaagtagct gggactacag gtatgtgcca ccacgcctgg ctaattttta tatttttagt
2401 agagacgggg tttcaccatg ttgtccaggc tggtctcaaa ctcctgacct caggtgatct
2461 gcccacctct gcctcccaaa gtgctgggat tacaggcatg agccaccatg cctggccatt
2521 tcttacactt ttgtatgaca tgcctattgc aagcttgcgt gcctctgtcc catgttattt
2581 tactctggga tttaggtgga gggagcagct tctatttgga acattggcca tcgcatggca
2641 aatgggtatc tgtcacttct gctcctattt agttggttct actataacct ttagagcaaa
2701 tcctgcagcc aagccaggca tcaatagggc agaaaagtat attctgtaaa taggggtgag
2761 gagaagatat ttctgaacaa tagtctactg cagtaccaaa ttgcttttca aagtggctgt
2821 tctaatgtac tcccgtcagt catataagtg tcatgtaagt atcccattga tccacatcct
2881 tgctaccctc tggtactatc aggtgccctt aattttgcca agccagtggg tatagaatga
2941 gatctcactg tggtcttagt ttgcatttgc ttggttactg atgagcacct tgtcaaatat
3001 ttatatacca tttgtgttta tttttttaaa taaaatgctt gctcatgctt ttttgcccat
3061 ttgcaaaaaa acttggggcc gggtgcagtg gctcatgcct gtagtcccag ctctttggga
3121 ggccaaggtg ggcagatcgc ttgagcccag gagttcgaga ccagccttgg caacatggcg
3181 aaaccctgtc tttacaaaaa atacaaaaat tagccgggtg tggtggtgtg cacctgaagt
3241 cccagctact cagtaggttc gctttgagcc tgggaggcag aggttgcagt gagctgggac
3301 cgcatcacta cacttcagcc tgggcaacag agaaaaacct tttctcagaa acaaacaaac
3361 ccaaatgtgg ttgtttgtcc tgattcctaa aaggtcttta tgtattctag ataataatct
3421 ttggtcagtt atatgtgtta aaaaatatct tctttgtggc caggcacggt agctcacacc -continued 3481 tgtaatccca gcactttgcg gggctgaggt gggtggatca tctgaggtca agagttcaag 3541 atcagcctgg ccaacacagt gaaaccccat ctctactaaa catgtacaaa acttagctgg 3601 gtatggtggc gggtgcctgt aaccccagct gctccagagg ctgtggcaga agaatcgctt 3661 gaacccagga ggcagaggtt gcagcgagcc aagattgtgc cattycactc cagactgggt 3721 gacaagagtg aaattctgcc tatctatcta tctatctatc tatatctata tatatatata 3781 tatatatcct ttqtaattta tttttccctt tttaaaattt tttataaaat tctttttat 3841 ttttattttt agcagaggtg aggtttctga ggtttcatta tgttgcccag gctggtcttg 3901 aactcctgag ctcaagtgat cctcccacct cagccttcca aagtgctgga attgcagaca 3961 tgagccaccg cgcccctcct gtttttctct aattaatggt gtctttcttt gtctttctgg 4021 taataagcaa aaagttcttc atttgatttg gttaaattta taactgtttt ctcatatggt 4081 taacattttt tcttgcctgg ctaaagaaat ccttttctgc ccaatactat aaagaggttt 4141 gcccacattt tattccaaaa gttttaagtt ttgtctttca tcttgaagtc taatgtatca 4201 ggaactggct tttgtgcctg ttgggaggta gtgatccaat tccatgtctt gcatgtaggt 4261 aaccactggt ccctgcgcca tgtattcaat acgtcgtctt tctcctgcgg gtctgcaatc 4321 tcacctacca tccatcaagt ttccataggg ccatgggtct gcttctgggc tccctgttct 4381 gttccattgt caatttgtct atcctgtgcc agtatcacac tgtgtttatt acaatagctt 4441 tgtaacagct ctcgatatcc ggtaggacat ctccctccac cttctttttc tacttcagaa 4501 gtgtcttagc taggtcaggc acggtggctc acgcctgtaa tcccagcact tryggaggcc 4561 gacgcggatg gatcacctga ggtcaggagt tttgagacag cctggccaac atggtgaaac 4621 cccatctcta ctaaaaaata caaaaattag tcaggcatgg tggcatgtgc ctgtaatccc 4681 agctatttcg gaggctgagg ccggagaatt gcttgaaccc ggggggcgga ggttgcagtg 4741 agccgagatc gtaccattgc actccagcct gggtgacaga gcgaaactct gtctcaggaa 4801 aaaaaagaaa agagatgtct tggttattct tggttcttta ttattcaata taaattttag 4861 aagctgaatt tgaaaagatt tggattggaa tttcattaaa tctacaggtc aatttaggga 4921 gagttgataa ttttacagaa ttgagtcatc tggtgttcca ataagaataa gagaacaatt 4981 attggctgta caattcttgc caaatagtag gcaaagcaaa gcttaggaag tatactggtg 5041 ccatttcagg aacaaagcta ggtgcgaata tttttgtctt tctgaatcat gatgctgtaa 5101 gttctaaagt gatttctcct cttggctttg gacacatggt gtttaattac ctactgctga 5161 ctatccacaa acagaaagag actggtcatg ccccacaggg ttggggtatc caagataatg 5221 gagcgaggct ctcatgtgtc ctaggttaca caccgaaaat ccacagttta ttctgtgaag 5281 aaaggaggct atgtttatga tacagactgt gatattttta tcatagccta ttctggtatc 5341 atgtgcaaaa gctataaatg aaaaacacag gaacttggca tgtgagtcat tgctcccccct 5401 aaatgacaat taataaggaa ggaacattga gacagaataa aatgatcccc ttctgggttt 5461 aatttagaaa gttccataat taggtttaat agaaataaat gtaaatttct atgattaaaa 5521 ataaattagc acatttaggg atacacaaat tataaatcat tttctaaatg ctaaaaacaa 5581 gctcaggttt ttttcagaag aaagttttaa tttttttttct ttagtggaag atatcactct 5641 gacggaaagt tttgatgtga ggggcggatg actataaagt gggcatcttc ccccacagga 5701 agatgtttcc atctgtgggt gagaggtgcc caccgcagct agggcaggtt acatgtgccc 5761 tgtgtgtggt aggacttgga gagtgatctt tatcaacgtt tttatttaaa agactatcta 5821 ataaaacaca aaactatgat gttcacagga aaaaaagaat aagaaaaaaa ga By "Cluster of Differentiation 247 (CD247) polypeptide" is meant a protein having at least about 85% amino acid sequence identity to NCBI Reference Sequence: NP_932170.1 or a fragment thereof. CD137 is also known as CD3•. An exemplary amino acid sequence is provided below.

```
>NP_932170.1 T-cell surface glycoprotein CD3 zeta chain isoform 1 precursor
[Homo sapiens]
                                                          (SEQ ID NO: 742)
  1  MKWKALFTAA ILQAQLPITE AQSFGLLDPK LCYLLDGILF IYGVILTALF LRVKFSRSAD

 61  APAYQQGQNQ LYNELNLGRR EEYDVLDKRR GRDPEMGGKP QRRKNPQEGL YNELQKDKMA

121  EAYSEIGMKG ERRRGKGHDG LYQGLSTATK DTYDALHMQA LPPR
```

-

By "Cluster of Differentiation 247 (CD247) polynucleotide" is meant a nucleic acid molecule encoding a CD247 polypeptide. An exemplary CD247 nucleic acid sequence is provided below.

```
>NM 198053.3 Homo sapiens CD247 molecule (CD247), transcript variant 1, mRNA
                                                            (SEQ ID NO: 743)
   1  aaccgtcccg gccaccgctg cctcagcctc tgcctcccag cctctttctg agggaaagga

  61  caagatgaag tggaaggcgc ttttcaccgc ggccatcctg caggcacagt tgccgattac

 121  agaggcacag agctttggcc tgctggatcc caaactctgc tacctgctgg atggaatcct

 181  cttcatctat ggtgtcattc tcactgcctt gttcctgaga gtgaagttca gcaggagcgc

 241  agacgccccc gcgtaccagc agggccagaa ccagctctat aacgagctca atctaggacg

 301  aagagaggag tacgatgttt tggacaagag acgtggccgg gaccctgaga tggggggaaa

 361  gccgcagaga aggaagaacc ctcaggaagg cctgtacaat gaactgcaga aagataagat

 421  ggcggaggcc tacagtgaga ttgggatgaa aggcgagcgc cggaggggca aggggcacga

 481  tggcctttac cagggtctca gtacagccac caaggacacc tacgacgccc ttcacatgca

 541  ggccctgccc cctcgctaac agccagggga tttcaccact caaaggccag acctgcagac

 601  gcccagatta tgagacacag gatgaagcat ttacaacccg gttcactctt ctcagccact

 661  gaagtattcc cctttatgta caggatgctt tggttatatt tagctccaaa ccttcacaca

 721  cagactgttg tccctgcact ctttaaggga gtgtactccc agggcttacg gccctggcct

 781  tgggccctct ggtttgccgg tggtgcaggt agacctgtct cctggcggtt cctcgttctc

 841  cctgggaggc gggcgcactg cctctcacag ctgagttgtt gagtctgttt tgtaaagtcc

 901  ccagagaaag cgcagatgct agcacatgcc ctaatgtctg tatcactctg tgtctgagtg

 961  gcttcactcc tgctgtaaat ttggcttctg ttgtcacctt cacctccttt caaggtaact

1021  gtactgggcc atgttgtgcc tccctggtga gagggccggg cagaggggca gatggaaagg

1081  agcctaggcc aggtgcaacc agggagctgc aggggcatgg gaaggtgggc gggcagggga

1141  gggtcagcca gggcctgcga gggcagcggg agcctccctg cctcaggcct ctgtgccgca

1201  ccattgaact gtaccatgtg ctacaggggc cagaagatga acagactgac cttgatgagc

1261  tgtgcacaaa gtggcataaa aaacatgtgg ttacacagtg tgaataaagt gctgcggagc

1321  aagaggaggc cgttgattca cttcacgctt tcagcgaatg acaaaatcat ctttgtgaag

1381  gcctcgcagg aagacccaac acatgggacc tataactgcc cagcggacag tggcaggaca

1441  ggaaaaaccc gtcaatgtac taggatactg ctgcgtcatt acagggcaca ggccatggat

1501  ggaaaacgct ctctactctg ctttttttct actgttttaa tttatactgg catgctaaag

1561  ccttcctatt ttgcataata aatgcttcag tgaaaatgca
```

"Co-administration" or "co-administered" refers to administering two or more therapeutic agents or pharmaceutical compositions during a course of treatment. Such co-administration can be simultaneous administration or sequential administration. Sequential administration of a later-administered therapeutic agent or pharmaceutical composition can occur at any time during the course of treatment after administration of the first pharmaceutical composition or therapeutic agent.

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained, serine for threonine such that a free-OH can be maintained; and glutamine for asparagine such that a free $-NH_2$ can be maintained.

The term "coding sequence" or "protein coding sequence" as used interchangeably herein refers to a segment of a polynucleotide that codes for a protein. Coding sequences can also be referred to as open reading frames. The region or sequence is bounded nearer the S' end by a start codon and nearer the 3' end with a stop codon. Stop codons useful with the base editors described herein include the following:

Glutamine CAG•TAG Stop codon
CAA•TAA
Arginine CGA•TGA
Tryptophan TGG•TGA
TGG•TAG
TGG•TAA By "complex" is meant a combination of two or more molecules whose interaction relies on inter-molecular forces. Non-limiting examples of inter-molecular forces include covalent and non-covalent interactions Non-limiting examples of non-covalent interactions include hydrogen bonding, ionic bonding, halogen bonding, hydrophobic bonding, van der Waals interactions (e.g., dipole-dipole interactions, dipole-induced dipole interactions, and London dispersion forces), and •-effects. In an embodiment, a complex comprises polypeptides, polynucleotides, or a combination of one or more polypeptides and one or more polynucleotides. In one embodiment, a complex comprises one or more polypeptides that associate to form a base editor (e.g., base editor comprising a nucleic acid programmable DNA binding protein, such as Cas9, and a deaminase) and a polynucleotide (e.g., a guide RNA). In an embodiment, the complex is held together by hydrogen bonds. It should be appreciated that one or more components of a base editor (e.g., a deaminase, or a nucleic acid programmable DNA binding protein) may associate covalently or non-covalently. As one example, a base editor may include a deaminase covalently linked to a nucleic acid programmable DNA binding protein (e.g., by a peptide bond). Alternatively, a base editor may include a deaminase and a nucleic acid programmable DNA binding protein that associate noncovalently (e.g., where one or more components of the base editor are supplied in trans and associate directly or via another molecule such as a protein or nucleic acid). In an embodiment, one or more components of the complex are held together by hydrogen bonds.

By "cytosine" or "4-Aminopyrimidin-2 (1H)-one" is meant a purine nucleobase with the molecular formula $C_4H_5N_3O$, having the structure

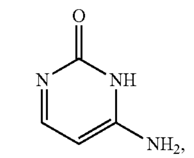

and corresponding to CAS No. 71-30-7.

By "cytidine" is meant a cytosine molecule attached to a ribose sugar via a glycosidic bond, having the structure

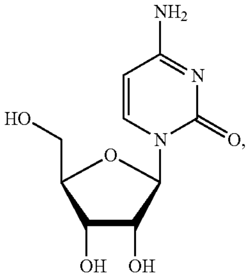

and corresponding to CAS No. 65-46-3. Its molecular formula is $C_9H_{13}N_3O_5$.

By "Cytidine Base Editor (CBE)" is meant a base editor comprising a cytidine deaminase.

By "Cytidine Base Editor (CBE) polynucleotide" is meant a polynucleotide comprising a CBE.

By "cytidine deaminase" or "cytosine deaminase" is meant a polypeptide or fragment thereof capable of deaminating cytidine or cytosine. In one embodiment, the cytidine deaminase converts cytosine to uracil or 5-methylcytosine to thymine. The terms "cytidine deaminase" and "cytosine deaminase" are used interchangeably throughout the application. *Petromyzon marinus* cytosine deaminase 1 (PmCDA1) (SEQ ID NO: 13-14), Activation-induced cytidine deaminase (AICDA) (SEQ ID NOs: 15-21), and APOBEC (SEQ ID NOs: 12-61) are exemplary cytidine deaminases. Further exemplary cytidine deaminase (CDA) sequences are provided in the Sequence Listing as SEQ ID NOs. 62-66 and SEQ ID NOs. 67-189.

By "cytosine" is meant a pyrimidine nucleobase with the molecular formula $C_4H_5N_3O$.

By "cytosine deaminase activity" is meant catalyzing the deamination of cytosine or cytidine. In one embodiment, a polypeptide having cytosine deaminase activity converts an amino group to a carbonyl group. In an embodiment, a cytosine deaminase converts cytosine to uracil (i.e., C to U) or 5-methylcytosine to thymine (i.e., 5mC to T). In some embodiments, a cytosine deaminase as provided herein has increased cytosine deaminase activity (e.g., at least 10-fold, 20-fold, 30-fold, 40-fold, 50-fold, 60-fold, 70-fold, 80-fold, 90-fold, 100-fold or more) relative to a reference cytosine deaminase.

The term "deaminase" or "deaminase domain," as used herein, refers to a protein or fragment thereof that catalyzes a deamination reaction.

In some embodiments, the adenosine deaminase is a TadA deaminase. In some embodiments, the TadA deaminase is TadA*7.10 variant. In some embodiments, the TadA*7.10 variant is a TadA*8. In some embodiments, the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an enzyme linked immunosorbent assay (ELISA)), biotin, digoxigenin, or haptens.

By "disease" is meant any condition or disorder that damages or interferes with the normal function of a cell, tissue, or organ. In one embodiment, the disease is a neoplasia or cancer. In some embodiments, the disease is a T- or NK-cell malignancy. In some embodiments, the T- or NK-cell malignancy is in precursor T- or NK-cells. In some embodiments, the T- or NK-cell malignancy is in mature T- or NK-cells. Nonlimiting examples of diseases include T-cell acute lymphoblastic leukemia (T-ALL), mycosis fungoides (MF), Sézary syndrome (SS), Peripheral T/NK•cell lymphoma, Anaplastic large cell lymphoma $ALK^+$, Primary cutaneous T•cell lymphoma, T•cell large granular lymphocytic leukemia, Angioimmunoblastic T/NK•cell lymphoma, Hepatosplenic T•cell lymphoma, Primary cutaneous $CD30^+$ lymphoproliferative disorders, Extranodal NK/T•cell lymphoma, Adult T•cell leukemia/lymphoma, T•cell prolymphocytic leukemia, Subcutaneous panniculitis•like T-cell lymphoma, Primary cutaneous gamma-delta T-cell lymphoma, Aggressive NK•cell leukemia, and Enteropathy•associated T•cell lymphoma.

By "effective amount" is meant the amount of an agent or active compound, e.g., a base editor as described herein, that is required to ameliorate the symptoms of a disease relative to an untreated patient or an individual without disease, i.e., a healthy individual, or is the amount of the agent or active compound sufficient to elicit a desired biological response. The effective amount of active compound(s) used to practice the present invention for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In one embodiment, an effective amount is the amount of a base editor of the invention sufficient to introduce an alteration in a gene of interest in a cell (e.g., a cell in vitro or in vivo). In one embodiment, an effective amount is the amount of a base editor required to achieve a therapeutic effect. Such therapeutic effect need not be sufficient to alter a pathogenic gene in all cells of a subject, tissue or organ, but only to alter the pathogenic gene in about 1%, 5%, 10%, 25%, 50%, 75% or more of the cells present in a subject, tissue or organ. In one embodiment, an effective amount is sufficient to ameliorate one or more symptoms of a disease.

"Epitope," as used herein, means an antigenic determinant. An epitope is the part of an antigen molecule that by its structure determines the specific antibody molecule that will recognize and bind it.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

By "fratricide" is meant the killing of immune cells by other immune cells, including self-antigen driven killing of immune cells. In certain embodiments, immune cells of the invention are genetically modified to prevent or reduce expression of antigens recognized by immune cells expressing a chimeric antigen receptor (CAR), thereby preventing or reducing fratricide. In various embodiments, fratricide may occur in vivo (e.g., in a subject) or ex vivo (e.g., in an immune cell preparation).

"Graft versus host disease" (GVHD) refers to a pathological condition where transplanted cells of a donor generate an immune response against cells of the host.

By "guide polynucleotide" is meant a polynucleotide or polynucleotide complex which is specific for a target sequence and can form a complex with a polynucleotide programmable nucleotide binding domain protein (e.g., Cas9 or Cpf1). In an embodiment, the guide polynucleotide is a guide RNA (gRNA). gRNAs can exist as a complex of two or more RNAs, or as a single RNA molecule.

As used herein, the term "hematopoietic stem cells" ("HSCs") refers to immature blood cells having the capacity to self-renew and to differentiate into mature blood cells containing diverse lineages including but not limited to granulocytes (e.g., promyelocytes, neutrophils, eosinophils, basophils), erythrocytes (e.g., reticulocytes, erythrocytes), thrombocytes (e.g., megakaryoblasts, platelet producing megakaryocytes, platelets), monocytes (e.g., monocytes, macrophages), dendritic cells, microglia, osteoclasts, and lymphocytes (e.g., NK cells, B-cells and T-cells). Such cells may include CD34+ cells. CD34+ cells are immature cells that express the CD34 cell surface marker. In humans, CD34+ cells are believed to include a subpopulation of cells with the stem cell properties defined above, whereas in mice, HSCs are CD34−. In addition, HSCs also refer to long term repopulating HSCs (LT-HSC) and short term repopulating HSCs (ST-HSC). LT-HSCs and ST-HSCs are differentiated, based on functional potential and on cell surface marker expression. For example, human HSCs are CD34+, CD38−, CD45RA−, CD90+, CD49F+, and lin-(negative for mature lineage markers including CD2, CD3, CD4, CD7, CD8, CD10, CD1 1 B, CD19, CD20, CD56, CD235A). In mice, bone marrow LT-HSCs are CD34−, SCA-1+, C-kit+, CD135−, Slamfl/CD150+, CD48−, and lin-(negative for mature lineage markers including Ter119, CD11b, Gr1, CD3, CD4, CD8, B220, IL7ra), whereas ST-HSCs are CD34+, SCA-1+, C-kit+, CD135−, Slamfl/CD150+, and lin-(negative for mature lineage markers including Ter1 19, CD1 1 b, Gr1, CD3, CD4, CD8, B220, IL7ra). In addition, ST-HSCs are less quiescent and more proliferative than LT-HSCs under homeostatic conditions. However, LT-HSC have greater self renewal potential (i.e., they survive throughout adulthood, and can be serially transplanted through successive recipients), whereas ST-HSCs have limited self renewal (i.e., they survive for only a limited period of time, and do not possess serial transplantation potential). Any of these HSCs can be used in the methods described herein. ST-HSCs are particularly useful because they are highly proliferative and thus, can more quickly give rise to differentiated progeny.

As used herein, the term "hematopoietic stem cell functional potential" refers to the functional properties of hematopoietic stem cells which include 1) multi-potency (which refers to the ability to differentiate into multiple different blood lineages including, but not limited to, granulocytes (e.g., promyelocytes, neutrophils, eosinophils, basophils), erythrocytes (e.g., reticulocytes, erythrocytes), thrombocytes (e.g., megakaryoblasts, platelet producing megakaryocytes, platelets), monocytes (e.g., monocytes, macrophages), dendritic cells, microglia, osteoclasts, and lymphocytes (e.g., NK cells, B-cells and T-cells), 2) self-renewal (which refers to the ability of hematopoietic stem cells to give rise to daughter cells that have equivalent potential as the mother cell, and further that this ability can repeatedly occur throughout the lifetime of an individual without exhaustion), and 3) the ability of hematopoietic stem cells or progeny thereof to be reintroduced into a transplant recipient whereupon they home to the hematopoietic stem cell niche and re-establish productive and sustained hematopoiesis."

By "heterologous," or "exogenous" is meant a polynucleotide or polypeptide that 1) has been experimentally incorporated to a polynucleotide or polypeptide sequence to which the polynucleotide or polypeptide is not normally found in nature; or 2) has been experimentally placed into a cell that does not normally comprise the polynucleotide or polypeptide. In some embodiments, "heterologous" means that a polynucleotide or polypeptide has been experimentally placed into a non-native context. In some embodiments, a heterologous polynucleotide or polypeptide is derived from a first species or host organism, and is incorporated into a polynucleotide or polypeptide derived from a second species or host organism. In some embodiments, the first species or host organism is different from the second species or host organism. In some embodiments the heterologous polynucleotide is DNA. In some embodiments the heterologous polynucleotide is RNA.

"Host versus graft disease" (HVGD) refers to a pathological condition where the immune system of a host generates an immune response against transplanted cells of a donor. "Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "immune cell" is meant a cell of the immune system capable of generating an immune response.

By "immune effector cell" is meant a lymphocyte, once activated, capable of effecting an immune response upon a target cell. In some embodiments, immune effector cells are effector T cells. In some embodiments, the effector T cell is a naïve $CD8^+$ T cell, a cytotoxic T cell, a natural killer T (NKT) cell, a natural killer (NK) cell, or a regulatory T (Treg) cell. In some embodiments, immune effector cells are effector NK cells. In some embodiments, the effector T cells are thymocytes, immature T lymphocytes, mature T lymphocytes, resting T lymphocytes, or activated T lymphocytes. In some embodiments the immune effector cell is a $CD4^+$ $CD8^+$ T cell or a $CD4^-$ $CD8^-$ T cell. In some embodiments the immune effector cell is a T helper cell. In some embodiments the T helper cell is a T helper 1 (Th1), a T helper 2 (Th2) cell, or a helper T cell expressing CD4 (CD4+ T cell).

By "immune response regulation gene" or "immune response regulator" is meant a gene that encodes a polypeptide that is involved in regulation of an immune response. An immune response regulation gene may regulate immune response in multiple mechanisms or on different levels. For example, an immune response regulation gene may inhibit or facilitate the activation of an immune cell, e.g. a T cell. An immune response regulation gene may increase or decrease the activation threshold of an immune cell. In some embodiments, the immune response regulation gene positively regulates an immune cell signal transduction pathway. In some embodiments, the immune response regulation gene negatively regulates an immune cell signal transduction pathway. In some embodiments, the immune response regulation gene encodes an antigen, an antibody, a cytokine, or a neuroendocrine.

By "immunogenic gene" is meant a gene that encodes a polypeptide that is able to elicit an immune response. For example, an immunogenic gene may encode an immunogen that elicits an immune response. In some embodiments, an immunogenic gene encodes a cell surface protein. In some embodiments, an immunogenic gene encodes a cell surface antigen or a cell surface marker. In some embodiments, the cell surface marker is a T cell marker or a B cell marker. In some embodiments, an immunogenic gene encodes a CD2, CD3e, CD3 delta, CD3 gamma, TRAC, TRBC1, TRBC2, CD4, CD5, CD7, CD8, CD19, CD23, CD27, CD28, CD30, CD33, CD52, CD70, CD127, CD122, CD130, CD132, CD38, CD69, CD11a, CD58, CD99, CD103, CCR4, CCR5, CCR6, CCR9, CCR10, CXCR3, CXCR4, CLA, CD161, B2M, or CIITA polypeptide.

By "increases" is meant a positive alteration of at least 10%, 25%, 50%, 75%, or 100%.

The terms "inhibitor of base repair", "base repair inhibitor", "IBR" or their grammatical equivalents refer to a protein that is capable in inhibiting the activity of a nucleic acid repair enzyme, for example a base excision repair enzyme.

An "intein" is a fragment of a protein that is able to excise itself and join the remaining fragments (the exteins) with a peptide bond in a process known as protein splicing.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker", as used herein, refers to a molecule that links two moieties. In one embodiment, the term "linker" refers to a covalent linker (e.g., covalent bond) or a non-covalent linker.

By "marker" is meant any protein or polynucleotide having an alteration in expression, level, structure, or activity that is associated with a disease or disorder. In embodiments, the disease or disorder is a T- or NK-cell malignancy. In some instances, the marker is a CD2 polypeptide.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)).

"Neoplasia" refers to cells or tissues exhibiting abnormal growth or proliferation. The term neoplasia encompasses cancer and solid tumors. In some embodiments, the neoplasia is a T- or NK-cell malignancy. In some embodiments, the T- or NK-cell malignancy is in precursor T- or NK-cells. In some embodiments, the T- or NK-cell malignancy is in mature T- or NK-cells. Nonlimiting examples of neoplasia include T-cell acute lymphoblastic leukemia (T-ALL), mycosis fungoides (MF), Sézary syndrome (SS), Peripheral T/NK•cell lymphoma, Anaplastic large cell lymphoma ALK+, Primary cutaneous T•cell lymphoma, T•cell large granular lymphocytic leukemia, Angioimmunoblastic T/NK•cell lymphoma, Hepatosplenic T•cell lymphoma, Primary cutaneous CD30+lymphoproliferative disorders, Extranodal NK/T•cell lymphoma, Adult T•cell leukemia/lymphoma, T•cell prolymphocytic leukemia, Subcutaneous panniculitis•like T-cell lymphoma, Primary cutaneous gamma-delta T-cell lymphoma, Aggressive NK•cell leukemia, and Enteropathy•associated T•cell lymphoma.

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5• to 3•direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (2•-e.g., fluororibose, ribose, 2•-deoxyribose, arabinose, and hexose); and/or modified phosphate groups (e.g., phosphorothioates and 5•-N-phosphoramidite linkages).

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 190), KRPAATKKAGQAKKKK (SEQ ID NO: 191), KKTELQTTNAENKTKKL (SEQ ID NO: 192), KRGINDRNFWRGENGRKTR (SEQ ID NO: 193), RKSGKIAAIVVKRPRK (SEQ ID NO: 194), PKKKRKV (SEQ ID NO: 195), or MDSLLMNRRKFLYQFKNVRWAKGRRETYLC (SEQ ID NO: 196).

The term "nucleobase," "nitrogenous base," or "base," used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (•). A "nucleotide" consists of a nucleobase, a five carbon sugar (either ribose or deoxyribose), and at least one phosphate group.

The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid or guide polynucleotide (e.g., gRNA), that guides the napDNAbp to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, Cas12i, and Cas12j/Cas• (Cas12j/Casphi). Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Cas12j/Cas•, Cpf1, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/crispr.2018.0033; Yan et al., "Functionally diverse type V CRISPR-Cas systems" *Science.* 2019 Jan. 4; 363 (6422): 88-91. doi: 10.1126/science.aav7271, the entire contents of each are hereby incorporated by reference. Exemplary nucleic acid programmable DNA binding proteins and nucleic acid sequences encoding nucleic acid programmable DNA binding proteins are provided in the Sequence Listing as SEQ ID NOs. 197-230.

The terms "nucleobase editing domain" or "nucleobase editing protein," as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., an adenine deaminase or an adenosine deaminase; or a cytidine deaminase or a cytosine deaminase).

As used herein, "obtaining" as in "obtaining an agent" includes synthesizing, purchasing, or otherwise acquiring the agent.

By "subject" is meant a mammal, including, but not limited to, a human or non-human mammal, such as a bovine, equine, canine, ovine, rodent, or feline. In an embodiment, "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient diagnosed with, at risk or having, predetermined to have, or suspected of having a disease or disorder.

The terms "pathogenic mutation", "pathogenic variant", "disease casing mutation", "disease causing variant", "deleterious mutation", or "predisposing mutation" refers to a genetic alteration or mutation that is associated with a disease or disorder or that increases an individual's susceptibility or predisposition to a certain disease or disorder. In some embodiments, the pathogenic mutation comprises at least one wild-type amino acid substituted by at least one pathogenic amino acid in a protein encoded by a gene. In some embodiments, the pathogenic mutation is in a terminating region (e.g., stop codon). In some embodiments, the pathogenic mutation is in a non-coding region (e.g., intron, promoter, etc.).

The term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). The terms such as "excipient," "carrier," "pharmaceutically acceptable carrier," "vehicle," or the like are used interchangeably herein.

The term "pharmaceutical composition" means a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

By "Programmed cell death 1 (PDCD1 or PD-1) polypeptide" is meant a protein having at least about 85% amino acid sequence identity to NCBI Accession No. AJS10360.1 or a fragment thereof. The PD-1 protein is thought to be involved in T cell function regulation during immune reactions and in tolerance conditions. An exemplary B2M polypeptide sequence is provided below.

>AJS10360.1 programmed cell death 1 protein [*Homo sapiens*]
(SEQ ID NO: 744)

MQIPQAPWPVVWAVLQLGWRPGWFLDSPDRPWNPPTFSPALLVVTEGDNATFTCSFSNTSESFV

LNWYRMSPSNQTDKLAAFPEDRSQPGQDCRFRVTQLPNGRDFHMSVVRARRNDSGTYLCGAISL

APKAQIKESLRAELRVTERRAEVPTAHPSPSPRPAGQFQTLVVGVVGGLLGSLVLLVWVLAVIC

SRAARGTIGARRTGQPLKEDPSAVPVFSVDYGELDFQWREKTPEPPVPCVPEQTEYATIVFPSG

MGTSSPARRGSADGPRSAQPLRPEDGHCSWPL

-

By "Programmed cell death 1 (PDCD1 or PD-1) polynucleotide" is meant a nucleic acid molecule encoding a PD-1 polypeptide. The PDCD1 gene encodes an inhibitory cell surface receptor that inhibits T-cell effector functions in an antigen-specific manner. An exemplary PDCD1 nucleic acid sequence is provided below.

>AY238517.1 *Homo sapiens* programmed cell death 1 (PDCD1) mRNA, complete cds
(SEQ ID NO: 745)

ATGCAGATCCCACAGGCGCCCTGGCCAGTCGTCTGGGCGGTGCTACAACTGGGCTGGCG

GCCAGGATGGTTCTTAGACTCCCCAGACAGGCCCTGGAACCCCCCCACCTTCTCCCCAGCCCTG

CTCGTGGTGACCGAAGGGGACAACGCCACCTTCACCTGCAGCTTCTCCAACACATCGGAGAGCT

TCGTGCTAAACTGGTACCGCATGAGCCCCAGCAACCAGACGGACAAGCTGGCCGCCTTCCCCGA

GGACCGCAGCCAGCCCGGCCAGGACTGCCGCTTCCGTGTCACACAACTGCCCAACGGGCGTGAC

TTCCACATGAGCGTGGTCAGGGCCCGGCGCAATGACAGCGGCACCTACCTCTGTGGGGCCATCT

CCCTGGCCCCCAAGGCGCAGATCAAAGAGAGCCTGCGGGCAGAGCTCAGGGTGACAGAGAGAAG

GGCAGAAGTGCCCACAGCCCACCCCAGCCCCTCACCCAGGCCAGCCGGCCAGTTCCAAACCCTG

GTGGTTGGTGTCGTGGGCGGCCTGCTGGGCAGCCTGGTGCTGCTAGTCTGGGTCCTGGCCGTCA

TCTGCTCCCGGGCCGCACGAGGGACAATAGGAGCCAGGCGCACCGGCCAGCCCCTGAAGGAGGA

CCCCTCAGCCGTGCCTGTGTTCTCTGTGGACTATGGGGAGCTGGATTTCCAGTGGCGAGAGAAG

ACCCCGGAGCCCCCCGTGCCCTGTGTCCCTGAGCAGACGGAGTATGCCACCATTGTCTTTCCTA

GCGGAATGGGCACCTCATCCCCCGCCCGCAGGGGCTCAGCTGACGGCCCTCGGAGTGCCCAGCC

ACTGAGGCCTGAGGATGGACACTGCTCTTGGCCCCTCTGA

By "promoter" is meant an array of nucleic acid control sequences, which direct transcription of a nucleic acid. A promoter includes necessary nucleic acid sequences near the start site of transcription. A promoter also optionally includes distal enhancer or repressor sequence elements. A "constitutive promoter" is a promoter that is continuously active and is not subject to regulation by external signals or molecules. In contrast, the activity of an "inducible promoter" is regulated by an external signal or molecule (for example, a transcription factor). By way of example, a promoter may be a CMV promoter.

The terms "protein", "peptide", "polypeptide", and their grammatical equivalents are used interchangeably herein, and refer to a polymer of amino acid residues linked together by peptide (amide) bonds. A protein, peptide, or polypeptide can be naturally occurring, recombinant, or synthetic, or any combination thereof.

The term "fusion protein" as used herein refers to a hybrid polypeptide which comprises protein domains from at least two different proteins.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell. In other embodiments and without limitation, a reference is an untreated cell that is not subjected to a test condition, or is subjected to placebo or normal saline, medium, buffer, and/or a control vector that does not harbor a polynucleotide of interest. In an embodiment, the reference is a cell containing an unedited target gene or that comprises a target gene that has not been edited according to the methods of the present disclosure. In some instances, the target gene is a CD2 gene.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, at least about 25 amino acids, about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, about 100 nucleotides or about 300 nucleotides or any integer thereabout or therebetween. In some embodiments, a reference sequence is a wild-type sequence of a protein of interest. In other embodiments, a reference sequence is a polynucleotide sequence encoding a wild-type protein.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease: RNA complex. Typically, the bound RNA(s) is referred to as a guide RNA (gRNA). In some embodiments, the RNA-programmable nuclease is the (CRISPR-associated system) Cas9 endonuclease, for example, Cas9 (Csn1) from *Streptococcus pyogenes.*

As used herein, the term "scFv" or "single-chain antibody" refers to a single chain Fv antibody in which the variable domains of the heavy chain and the light chain from an antibody have been joined to form one chain. scFv fragments contain a single polypeptide chain that includes the variable region of an antibody light chain (VL) (e.g., CDR-L1, CDR-L2, and/or CDR-L3) and the variable region of an antibody heavy chain (VH) (e.g., CDR-H1, CDR-H2, and/or CDR-H3) separated by a linker. The linker that joins the VL and VH regions of a scFv fragment can be a peptide linker composed of proteinogenic amino acids. Alternative linkers can be used to so as to increase the resistance of the scFv fragment to proteolytic degradation (for example, linkers containing D-amino acids), in order to enhance the solubility of the scFv fragment (for example, hydrophilic linkers such as polyethylene glycol-containing linkers or polypeptides containing repeating glycine and serine residues), to improve the biophysical stability of the molecule (for example, a linker containing cysteine residues that form intramolecular or intermolecular disulfide bonds), or to attenuate the immunogenicity of the scFv fragment (for example, linkers containing glycosylation sites). It will also be understood by one of ordinary skill in the art that the variable regions of the scFv molecules described herein can be modified such that they vary in amino acid sequence from the antibody molecule from which they were derived. For example, nucleotide or amino acid substitutions leading to conservative substitutions or changes at amino acid residues can be made (e.g., in CDR and/or framework residues) so as to preserve or enhance the ability of the scFv to bind to the antigen recognized by the corresponding antibody.

By "selectively binds" is meant specifically binds a wild-type version of the cell surface protein, but exhibits reduced binding or fails to bind to the cell surface protein comprising a mutation.

By "signaling domain" is meant an intracellular portion of a protein expressed in a T cell that transduces a T cell effector function signal (e.g., an activation signal) and directs the T cell to perform a specialized function. T cell activation can be induced by a number of factors, including binding of cognate antigen to the T cell receptor on the surface of T cells and binding of cognate ligand to costimulatory molecules on the surface of the T cell. A T cell co-stimulatory molecule is a cognate binding partner on a T cell that specifically binds with a co-stimulatory ligand, thereby mediating a co-stimulatory response by the T cell, such as, but not limited to, proliferation. Co-stimulatory molecules include, but are not limited to an MHC class I molecule. In some embodiments, the co-stimulatory domain is a CD2 cytoplasmic domain. Activation of a T cell leads to immune response, Such as T cell proliferation and differentiation (see, e.g., Smith-Garvin et al., Annu. Rev. Immunol., 27:591-619, 2009). Exemplary T cell signaling domains are known in the art. Non-limiting examples include the CD2, CD3•, CD8, CD28, CD27, CD154, GITR (TNFRSF18), CD134 (OX40), and CD137 (4-1BB) signaling domains.

The term "single nucleotide polymorphism (SNP)" is a variation in a single nucleotide that occurs at a specific position in the genome, where each variation is present to some appreciable degree within a population (e.g., >1%).

By "specifically binds" is meant a nucleic acid molecule, polypeptide, polypeptide/polynucleotide complex, compound, or molecule that recognizes and binds a polypeptide and/or nucleic acid molecule of the invention, but which does not substantially recognize and bind other molecules in a sample, for example, a biological sample.

By "substantially identical" is meant a polypeptide or nucleic acid molecule exhibiting at least 50% identity to a reference amino acid sequence. In one embodiment, a reference sequence is a wild-type amino acid or nucleic acid sequence. In another embodiment, a reference sequence is any one of the amino acid or nucleic acid sequences described herein. In one embodiment, such a sequence is at least 60%, 80%, 85%, 90%, 95% or even 99% identical at the amino acid level or nucleic acid level to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence. COBALT is used, for example, with the following parameters:

a) alignment parameters: Gap penalties-11,-1 and End-Gap penalties-5,-1,
b) CDD Parameters: Use RPS BLAST on; Blast E-value 0.003; Find Conserved columns and Recompute on, and
c) Query Clustering Parameters: Use query clusters on; Word Size 4; Max cluster distance 0.8; Alphabet Regular.

EMBOSS Needle is used, for example, with the following parameters:

a) Matrix: BLOSUM62;
b) GAP OPEN: 10;
c) GAP EXTEND: 0.5;
d) OUTPUT FORMAT: pair;
e) END GAP PENALTY: false;
f) END GAP OPEN: 10, and
g) END GAP EXTEND: 0.5.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred: embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 μg/ml denatured salmon sperm DNA (ssDNA). In a most preferred embodiment, hybridization will occur at 42° C. in 250 mM NaCl, 25 mM trisodium citrate, 1% SDS, 50% formamide, and 200•g/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In another embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:180, 1977); Grunstein and Hogness (Proc. Natl Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By “split” is meant divided into two or more fragments.

A “split Cas9 protein” or “split Cas9” refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a “reconstituted” Cas9 protein.

The term “target site” refers to a sequence within a nucleic acid molecule that is deaminated by a deaminase (e.g., cytidine or adenine deaminase), a fusion protein comprising a deaminase (e.g., a dCas9-adenosine deaminase fusion protein), or a base editor (e.g., adenine or adenosine base editor (ABE) or a cytidine or a cytosine base editor (CBE)) as disclosed herein).

By “T Cell Receptor Alpha Constant (TRAC) polypeptide” is meant a protein having at least about 85% amino acid sequence identity to NCBI Accession No. P01848.2 or fragment thereof and having immunomodulatory activity. An exemplary amino acid sequence is provided below.

```
>sp|P01848.2|TRAC_HUMAN RecName: Full = T cell receptor alpha constant
                                                        (SEQ ID NO: 746)
IQNPDPAVYQLRDSKSSDKSVCLFTDFDSQTNVSQSKDSDVYITDKTVLDMRSMDFKSNSAVAW

SNKSDFACANAFNNSIIPEDTFFPSPESSCDVKLVEKSFETDTNLNFQNLSVIGFRILLLKVAG

FNLLMTLRLWSS
```

-

By “T Cell Receptor Alpha Constant (TRAC) polynucleotide” is meant a nucleic acid encoding a TRAC polypeptide. Exemplary TRAC nucleic acid sequences are provided below. UCSC human genome database, Gene ENSG00000277734.8 Human T-cell receptor alpha chain (TCR-alpha)

```
                                                        (SEQ ID NO: 747)
catgctaatcctccggcaaacctctgtttcctcctcaaaggcaggaggtcggaaagaataaac

aatgagagtcacattaaaaacacaaaatcctacggaaatactgaagaatgagtctcagcactaa

ggaaaagcctccagcagctcctgctttctgagggtgaaggatagacgctgtggctctgcatgac

tcactagcactctatcacggccatattctggcagggtcagtggctccaactaacatttgtttgg

tactttacagtttattaaatagatgtttatatggagaagctctcatttctttctcagaagagcc

tggctaggaaggtggatgaggcaccatattcattttgcaggtgaaattcctgagatgtaaggag

ctgctgtgacttgctcaaggccttatatcgagtaaacggtagtgctggggcttagacgcaggtg

ttctgatttatagttcaaaacctctatcaatgagagagcaatctcctggtaatgtgatagattt

cccaacttaatgccaacataccataaacctcccattctgctaatgcccagcctaagttggggag

accactccagattccaagatgtacagtttgctttgctgggcctttttcccatgcctgcctttac

tctgccagagttatattgctggggttttgaagaagatcctattaaataaaagaataagcagtat

tattaagtagccctgcatttcaggtttccttgagtggcaggccaggcctggccgtgaacgttca

ctgaaatcatggcctcttggccaagattgatagcttgtgcctgtccctgagtcccagtccatca

cgagcagctggtttctaagatgctatttcccgtataaagcatgagaccgtgacttgccagcccc

acagagccccgcccttgtccatcactggcatctggactccagcctgggttggggcaaagaggga

aatgagatcatgtcctaaccctgatcctcttgtcccacagATATCCAGAACCCTGACCCTGCCG

TGTACCAGCTGAGAGACTCTAAATCCAGTGACAAGTCTGTCTGCCTATTCACCGATTTTGATTC

TCAAACAAATGTGTCACAAAGTAAGGATTCTGATGTGTATATCACAGACAAAACTGTGCTAGAC

ATGAGGTCTATGGACTTCAAGAGCAACAGTGCTGTGGCCTGGAGCAACAAATCTGACTTTGCAT

GTGCAAACGCCTTCAACAACAGCATTATTCCAGAAGACACCTTCTTCCCCAGCCCAGgtaaggg

cagctttggtgccttcgcaggctgtttccttgcttcaggaatggccaggttctgcccagagctc

tggtcaatgatgtctaaaactcctctgattggtggtctcggccttatccattgccaccaaaacc

ctctttttactaagaaacagtgagccttgttctggcagtccagagaatgacacgggaaaaaagc

agatgaagagaaggtggcaggagagggcacgtggcccagcctcagtctctccaactgagttcct
```

-continued gcctgcctgcctttgctcagactgtttgccccttactgctcttctaggcctcattctaagcccc ttctccaagttgcctctccttatttctccctgtctgccaaaaaatctttcccagctcactaagt cagtctcacgcagtcactcattaacccaccaatcactgattgtgccggcacatgaatgcaccag gtgttgaagtggaggaattaaaaagtcagatgaggggtgtgcccagaggaagcaccattctagt tggggggagcccatctgtcagctgggaaaagtccaaataacttcagattggaatgtgttttaact cagggttgagaaaacagctaccttcaggacaaaagtcagggaagggctctctgaagaaatgcta cttgaagataccagccctaccaagggcagggagaggaccctatagaggcctgggacaggagctc aatgagaaaggagaagagcagcaggcatgagttgaatgaaggaggcagggccgggtcacagggc cttctaggccatgagagggtagacagtattctaaggacgccagaaagctgttgatcggcttcaa gcaggggagggacacctaatttgcttttcttttttttttttttttttttttttttgagat ggagttttgctcttgttgcccaggctggagtgcaatggtgcatcttggctcactgcaacctccg cctcccaggttcaagtgattctcctgcctcagcctcccgagtagctgagattacaggcacccgc caccatgcctggctaatttttttgtatttttagtagagacagggtttcactatgttggccaggct ggtctcgaactcctgacctcaggtgatccacccgcttcagcctcccaaagtgctgggattacag gcgtgagccaccacacccggcctgcttttcttaaagatcaatctgagtgctgtacggagagtgg gttgtaagccaagagtagaagcagaaagggagcagttgcagcagagagatgatggaggcctggg cagggtggtggcagggaggtaaccaacaccattcaggtttcaaaggtagaaccatgcagggatg agaaagcaaagaggggatcaaggaaggcagctggattttggcctgagcagctgagtcaatgata gtgccgtttactaagaagaaaccaaggaaaaaatttggggtgcagggatcaaaactttttggaa catatgaaagtacgtgtttatactctttatggcccttgtcactatgtatgcctcgctgcctcca ttggactctagaatgaagccaggcaagagcagggtctatgtgtgatggcacatgtggccagggt catgcaacatgtactttgtacaaacagtgtatattgagtaaatagaaatggtgtccaggagccg aggtatcggtcctgccagggccaggggctctccctagcaggtgctcatatgctgtaagttccct ccagatctctccacaaggaggcatggaaaggctgtagttgttcacctgcccaagaactaggagg tctggggtgggagagtcagcctgctctggatgctgaaagaatgtctgtttttccttttagAAAG TTCCTGTGATGTCAAGCTGGTCGAGAAAAGCTTTGAAACAGgtaagacaggggtctagcctggg tttgcacaggattgcggaagtgatgaacccgcaataaccctgcctggatgagggagtgggaaga aattagtagatgtgggaatgaatgatgaggaatggaaacagcggttcaagacctgcccagagct gggtggggtctctcctgaatccctctcaccatctctgactttccattctaagcactttgaggat gagtttctagcttcaatagaccaaggactctctcctaggcctctgtattcctttcaacagctcc actgtcaagagagccagagagagcttctgggtggcccagctgtgaaatttctgagtcccttagg gatagccctaaacgaaccagatcatcctgaggacagccaagaggttttgccttctttcaagaca agcaacagtactcacataggctgtgggcaatggtcctgtctctcaagaatcccctgccactcct cacacccaccctgggcccatattcatttccatttgagttgttcttattgagtcatccttcctgt ggtagcggaactcactaaggggcccatctggacccgaggtattgtgatgataaattctgagcac ctaccccatccccagaagggctcagaaataaaataagagccaagtctagtcggtgtttcctgtc ttgaaacacaatactgttggccctggaagaatgcacagaatctgtttgtaaggggatatgcaca gaagctgcaagggacaggaggtgcaggagctgcaggcctcccccacccagcctgctctgccttg gggaaaaccgtgggtgtgtcctgcaggccatgcaggcctgggacatgcaagcccataaccgctg tggcctcttggttttacagATACGAACCTAAACTTTCAAAACCTGTCAGTGATTGGGTTCCGAA TCCTCCTCCTGAAAGTGGCCGGGITTAATCTGCTCATGACGCTGCGGCTGTGGTCCAGCTGAGg -continued tgaggggccttgaagctgggagtggggtttagggacgcgggtctctgggtgcatcctaagctct gagagcaaacctccctgcagggtcttgcttttaagtccaaagcctgagcccaccaaactctcct acttcttcctgttacaaattcctcttgtgcaataataatggcctgaaacgctgtaaaatatcct catttcagccgcctcagttgcacttctcccctatgaggtaggaagaacagttgtttagaaacga agaaactgaggccccacagctaatgagtggaggaagagagacacttgtgtacaccacatgcctt gtgttgtacttctctcaccgtgtaacctcctcatgtcctctctccccagtacggctctcttagc tcagtagaaagaagacattacactcatattacaccccaatcctggctagagtctccgcaccctc ctcccccagggtccccagtcgtcttgctgacaactgcatcctgttccatcaccatcaaaaaaaa actccaggctgggtgcgggggctcacacctgtaatcccagcactttgggaggcagaggcaggag gagcacaggagctggagaccagcctgggcaacacagggagaccccgcctctacaaaaagtgaaa aaattaaccaggtgtggtgctgcacacctgtagtcccagctacttaagaggctgagatgggagg atcgcttgagccctggaatgttgaggctacaatgagctgtgattgcgtcactgcactccagcct ggaagacaaagcaagatcctgtctcaaataataaaaaaaataagaactccagggtacatttgct cctagaactctaccacatagccccaaacagagccatcaccatcacatccctaacagtcctgggt cttcctcagtgtccagcctgacttctgttcttcctcattccagATCTGCAAGATTGTAAGACAG

CCTGTGCTCCCTCGCTCCTTCCTCTGCATTGCCCCTCTTCTCCCTCTCCAAACAGAGGGAACTC

TCCTACCCCCAAGGAGGTGAAAGCTGCTACCACCTCTGTGCCCCCCCGGCAATGCCACCAACTG

GATCCTACCCGAATTTATGATTAAGATTGCTGAAGAGCTGCCAAACACTGCTGCCACCCCCTCT

GTTCCCTTATTGCTGCTTGTCACTGCCTGACATTCACGGCAGAGGCAAGGCTGCTGCAGCCTCC

CCTGGCTGTGCACATTCCCTCCTGCTCCCCAGAGACTGCCTCCGCCATCCCACAGATGATGGAT

CTTCAGTGGGTTCTCTTGGGCTCTAGGTCCTGCAGAATGTTGTGAGGGGTTTATTTTTTTTTAA

TAGTGTTCATAAAGAAATACATAGTATTCTTCTTCTCAAGACGTGGGGGGAAATTATCTCATTA

TCGAGGCCCTGCTATGCTGTGTATCTGGGCGTGTTGTATGTCCTGCTGCCGATGCCTTCATTAA

AATGATTTGGAAGAGCAGA

Nucleotides in lower cases above are untranslated regions or introns, and nucleotides in upper cases are exons.

>X02592.1 Human mRNA for T-cell receptor alpha chain (TCR-alpha)
(SEQ ID NO: 748)

TTTTGAAACCCTTCAAAGGCAGAGACTTGTCCAGCCTAACCTGCCTGCTGCTCCTAGCTCCTGA

GGCTCAGGGCCCTTGGCTTCTGTCCGCTCTGCTCAGGGCCCTCCAGCGTGGCCACTGCTCAGCC

ATGCTCCTGCTGCTCGTCCCAGTGCTCGAGGTGATTTTTACCCTGGGAGGAACCAGAGCCCAGT

CGGTGACCCAGCTTGGCAGCCACGTCTCTGTCTCTGAAGGAGCCCTGGTTCTGCTGAGGTGCAA

CTACTCATCGTCTGTTCCACCATATCTCTTCTGGTATGTGCAATACCCCAACCAAGGACTCCAG

CTTCTCCTGAAGTACACATCAGCGGCCACCCTGGTTAAAGGCATCAACGGTTTTGAGGCTGAAT

TTAAGAAGAGTGAAACCTCCTTCCACCTGACGAAACCCTCAGCCCATATGAGCGACGCGGCTGA

GTACTTCTGTGCTGTGAGTGATCTCGAACCGAACAGCAGTGCTTCCAAGATAATCTTTGGATCA

GGGACCAGACTCAGCATCCGGCCAAATATCCAGAACCCTGACCCTGCCGTGTACCAGCTGAGAG

ACTCTAAATCCAGTGACAAGTCTGTCTGCCTATTCACCGATTTTGATTCTCAAACAAATGTGTC

ACAAAGTAAGGATTCTGATGTGTATATCACAGACAAAACTGTGCTAGACATGAGGTCTATGGAC

TTCAAGAGCAACAGTGCTGTGGCCTGGAGCAACAAATCTGACTTTGCATGTGCAAACGCCTTCA

-continued

ACAACAGCATTATTCCAGAAGACACCTTCTTCCCCAGCCCAGAAAGTTCCTGTGATGTCAAGCT

GGTCGAGAAAAGCTTTGAAACAGATACGAACCTAAACTTTCAAAACCTGTCAGTGATTGGGTTC

CGAATCCTCCTCCTGAAAGTGGCCGGGTTTAATCTGCTCATGACGCTGCGGCTGTGGTCCAGCT

GAGATCTGCAAGATTGTAAGACAGCCTGTGCTCCCTCGCTCCTTCCTCTGCATTGCCCCTCTTC

TCCCTCTCCAAACAGAGGGAACTCTCCTACCCCCAAGGAGGTGAAAGCTGCTACCACCTCTGTG

CCCCCCCGGTAATGCCACCAACTGGATCCTACCCGAATTTATGATTAAGATTGCTGAAGAGCTG

CCAAACACTGCTGCCACCCCCTCTGTTCCCTTATTGCTGCTTGTCACTGCCTGACATTCACGGC

AGAGGCAAGGCTGCTGCAGCCTCCCCTGGCTGTGCACATTCCCTCCTGCTCCCCAGAGACTGCC

TCCGCCATCCCACAGATGATGGATCTTCAGTGGGTTCTCTTGGGCTCTAGGTCCTGGAGAATGT

TGTGAGGGGTTTATTTTTTTTTAATAGTGTTCATAAAGAAATACATAGTATTCTTCTTCTCAAG

ACGTGGGGGGAAATTATCTCATTATCGAGGCCCTGCTATGCTGTGTGTCTGGGCGTGTTGTATG

TCCTGCTGCCGATGCCTTCATTAAAATGATTIGGAA

By "T cell receptor beta constant 1 polypeptide (TRBC1)" is meant a protein having at least about 85% amino acid sequence identity to NCBI Accession No. P01850 or fragment thereof and having immunomodulatory activity. An exemplary amino acid sequence is provided below.

>sp|P01850|TRBC1 HUMAN T cell receptor beta constant 1 OS = *Homo sapiens* OX = 9606 GN = TRBC1 PE = 1 SV = 4

(SEQ ID NO: 749)

DLNKVFPPEVAVFEPSEAEISHTQKATLVCLATGFFPDHVELSWWVNGKEVHSGVSTDPQPLKE

QPALNDSRYCLSSRLRVSATFWQNPRNHFRCQVQFYGLSENDEWTQDRAKPVTQIVSAEAWGRA

DCGFTSVSYQQGVLSATILYEILLGKATLYAVLVSALVLMAMVKRKDF

By "T cell receptor beta constant 1 polynucleotide (TRBC1)" is meant a nucleic acid encoding a TRBC1 polypeptide. An exemplary TRBC1 nucleic acid sequence is provided below.

>X00437.1

(SEQ ID NO: 750)

CTGGTCTAGAATATTCCACATCTGCTCTCACTCTGCCATGGACTCCTGGACCTTCTGCTGTGTG

TCCCTTTGCATCCTGGTAGCGAAGCATACAGATGCTGGAGTTATCCAGTCACCCCGCCATGAGG

TGACAGAGATGGGACAAGAAGTGACTCTGAGATGTAAACCAATTTCAGGCCACAACTCCCTTTT

CTGGTACAGACAGACCATGATGCGGGGACTGGAGTTGCTCATTTACTTTAACAACAACGTTCCG

ATAGATGATTCAGGGATGCCCGAGGATCGATTCTCAGCTAAGATGCCTAATGCATCATTCTCCA

CTCTGAAGATCCAGCCCTCAGAACCCAGGGACTCAGCTGTGTACTTCTGTGCCAGCAGTTTCTC

GACCTGTTCGGCTAACTATGGCTACACCTTCGGTTCGGGGACCAGGTTAACCGTTGTAGAGGAC

CTGAACAAGGTGTTCCCACCCGAGGTCGCTGTGTTTGAGCCATCAGAAGCAGAGATCTCCCACA

CCCAAAAGGCCACACTGGTGTGCCTGGCCACAGGCTTCTTCCCCGACCACGTGGAGCTGAGCTG

GTGGGIGAATGGGAAGGAGGTGCACAGTGGGGTCAGCACAGACCCGCAGCCCCTCAAGGAGCAG

CCCGCCCTCAATGACTCCAGATACTGCCTGAGCAGCCGCCTGAGGGTCTCGGCCACCTTCTGGC

AGAACCCCCGCAACCACTTCCGCTGTCAAGTCCAGTICTACGGGCTCTCGGAGAATGACGAGTG

GACCCAGGATAGGGCCAAACCCGTCACCCAGATCGTCAGCGCCGAGGCCTGGGGTAGAGCAGAC

TGTGGCTTTACCTCGGTGTCCTACCAGCAAGGGGTCCTGTCTGCCACCATCCTCTATGAGATCC

TGCTAGGGAAGGCCACCCTGTATGCTGTGCTGGTCAGCGCCCTTGTGTTGATGGCCATGGTCAA

-continued

GAGAAAGGATTTCTGAAGGCAGCCCTGGAAGTGGAGTTAGGAGCTTCTAACCCGTCATGGTTCA

ATACACATTCTTCTTTTGCCAGCGCTTCTGAAGAGCTGCTCTCACCTCTCTGCATCCCAATAGA

TATCCCCCTATGTGCATGCACACCTGCACACTCACGGCTGAAATCTCCCTAACCCAGGGGGAC

By "T cell receptor beta constant 2 polypeptide (TRBC2)" is meant a protein having at least about 85% amino acid sequence identity to NCBI Accession No. A0A5B9 or fragment thereof and having immunomodulatory activity. An exemplary amino acid sequence is provided below.

>sp|A0A5B9|TRBC2_HUMAN T cell receptor beta constant 2 OS = *Homo sapiens* OX = 9606 GN = TRBC2 PE = 1 SV = 2

(SEQ ID NO: 751)

DLKNVFPPKVAVFEPSEAEISHTQKATLVCLATGFYPDHVELSWWVNGKEVHSGVSTDPQPLKE

QPALNDSRYCLSSRLRVSATFWQNPRNHFRCQVQFYGLSENDEWTQDRAKPVTQIVSAEAWGRA

DCGFTSESYQQGVISATILYEILLGKATLYAVLVSALVLMAMVKRKDSRG

By "T cell receptor beta constant 2 polynucleotide (TRBC2)" is meant a nucleic acid encoding a TRAC polypeptide. An exemplary TRBC2 nucleic acid sequence is provided below.

>NG_001333.2:655095-656583 *Homo sapiens* T cell receptor beta locus (TRB) on chromosome7

(SEQ ID NO: 752)

AGGACCTGAAAAACGTGTTCCCACCCGAGGTCGCTGTGTTTGAGCCATCAGAAGCAGAGATCTC

CCACACCCAAAAGGCCACACTGGTATGCCTGGCCACAGGCTTCTACCCCGACCACGTGGAGCTG

AGCTGGTGGGTGAATGGGAAGGAGGTGCACAGTGGGGTCAGCACAGACCCGCAGCCCCTCAAGG

AGCAGCCCGCCCTCAATGACTCCAGATACTGCCTGAGCAGCCGCCTGAGGGTCTCGGCCACCTT

CTGGCAGAACCCCCGCAACCACTTCCGCTGTCAAGTCCAGTTCTACGGGCTCTCGGAGAATGAC

GAGTGGACCCAGGATAGGGCCAAACCCGTCACCCAGATCGTCAGCGCCGAGGCCTGGGGTAGAG

CAGGTGAGTGGGGCCTGGGGAGATGCCTGGAGGAGATTAGGTGAGACCAGCTACCAGGGAAAAT

GGAAAGATCCAGGTAGCGGACAAGACTAGATCCAGAAGAAAGCCAGAGTGGACAAGGTGGGATG

ATCAAGGTTCACAGGGTCAGCAAAGCACGGTGTGCACTTCCCCCACCAAGAAGCATAGAGGCTG

AATGGAGCACCTCAAGCTCATTCTTCCTTCAGATCCTGACACCTTAGAGCTAAGCTTTCAAGTC

TCCCTGAGGACCAGCCATACAGCTCAGCATCTGAGTGGTGTGCATCCCATTCTCTTCTGGGGTC

CTGGTTTCCTAAGATCATAGTGACCACTTCGCTGGCACTGGAGCAGCATGAGGGAGACAGAACC

AGGGCTATCAAAGGAGGCTGACTTTGTACTATCTGATATGCATGTGTTTGTGGCCTGTGAGTCT

GTGATGTAAGGCTCAATGTCCTTACAAAGCAGCATTCTCTCATCCATTTTTCTTCCCCTGTTTT

CTTTCAGACTGTGGCTTCACCTCCGGTAAGTGAGTCTCTCCTTTTTCTCTCTATCTTTCGCCGT

CTCTGCTCTCGAACCAGGGCATGGAGAATCCACGGACACAGGGGCGTGAGGGAGGCCAGAGCCA

CCTGTGCACAGGTGCCTACATGCTCTGTTCTTGTCAACAGAGTCTTACCAGCAAGGGGTCCTGT

CTGCCACCATCCTCTATGAGATCTTGCTAGGGAAGGCCACCTTGTATGCCGTGCTGGTCAGTGC

CCTCGTGCTGATGGCCATGGTAAGGAGGAGGGTGGGATAGGGCAGATGATGGGGGCAGGGGATG

GAACATCACACATGGGCATAAAGGAATCTCAGAGCCAGAGCACAGCCTAATATATCCTATCACC

TCAATGAAACCATAATGAAGCCAGACTGGGGAGAAAATGCAGGGAATATCACAGAATGCATCAT

GGGAGGATGGAGACAACCAGCGAGCCCTACTCAAATTAGGCCTCAGAGCCCGCCTCCCCTGCCC

-continued

TACTCCTGCTGTGCCATAGCCCCTGAAACCCTGAAAATGTTCTCTCTTCCACAGGTCAAGAGAA

AGGATTCCAGAGGCTAG

As used herein "transduction" means to transfer a gene or genetic material to a cell via a viral vector.

"Transformation," as used herein refers to the process of introducing a genetic change in a cell produced by the introduction of exogenous nucleic acid.

"Transfection" refers to the transfer of a gene or genetical material to a cell via a chemical or physical means.

By "translocation" is meant the rearrangement of nucleic acid segments between non-homologous chromosomes.

By "transmembrane domain" is meant an amino acid sequence that inserts into a lipid bilayer, such as the lipid bilayer of a cell or virus or virus-like particle. A transmembrane domain can be used to anchor a protein of interest (e.g., a CAR) to a membrane. The transmembrane domain may be derived either from a natural or from a synthetic source. Where the source is natural, the domain may be derived from any membrane-bound or transmembrane protein. Transmembrane domains for use in the disclosed CARs can include at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some embodiments, the transmembrane domain is derived from CD4, CD8•, CD28 and CD3•. In some embodiments, the transmembrane domain is a CD8• hinge and transmembrane domain.

As used herein, the terms "treat," treating." "treatment," and the like refer to reducing or ameliorating a disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein.

By "uracil glycosylase inhibitor" or "UGI" is meant an agent that inhibits the uracil-excision repair system. Base editors comprising a cytidine deaminase convert cytosine to uracil, which is then converted to thymine through DNA replication or repair. Including an inhibitor of uracil DNA glycosylase (UGI) in the base editor prevents base excision repair which changes the U back to a C. An exemplary UGI comprises an amino acid sequence as follows:

>sp|14739|UNGI_BPPB2 Uracil-DNA glycosylase inhibitor
(SEQ ID NO: 231)
MTNLSDIIEKETGKQLVIQESILMLPEEVEEVIGNKPESDILVHTAYDESTDENVMLLTSD
APEYKPWALVIQDSNGENKIKML The term "vector" refers to a means of introducing a nucleic acid sequence into a cell, resulting in a transformed cell. Vectors include plasmids, transposons, phages, viruses, liposomes, and episome. "Expression vectors" are nucleic acid sequences comprising the nucleotide sequence to be expressed in the recipient cell. Expression vectors may include additional nucleic acid sequences to promote and/or facilitate the expression of the of the introduced sequence such as start, stop, enhancer, promoter, and secretion sequences.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

All terms are intended to be understood as they would be understood by a person skilled in the art. Unless defined otherwise, all technical and scientific terms used herein have the same meaning as commonly understood by one of ordinary skill in the art to which the disclosure pertains In this application, the use of the singular includes the plural unless specifically stated otherwise. It must be noted that, as used in the specification, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, e.g., within 5-fold, within 2-fold of a value. Where particular values are described in the application and claims, unless otherwise stated, the term "about" means within an acceptable error range for the particular value should be assumed.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

BRIEF DESCRIPTION OF THE DRAWINGS

In FIGS. 7A-7E the notation "LV" followed by a number indicates a population of cells transduced with a lentiviral vector (LV) encoding the anti-CD2 CAR corresponding to the number (e.g., LV118 represents cells transduced using a lentiviral vector encoding pCAR_BTx118 ((SEQ ID NO: 754), see Table 20), "UTD" represents "untransduced cells" containing a CD2 gene that has been knocked out according to the methods provided herein using base editing, and "EP Only" represents "electroporation (EP) only" represents cells containing an unedited and functional CD2 gene and that have not been transduced with any lentiviral vector. The gating used for preparation of FIGS. 7A-7E was as follows: Gated on Singlets>Live. Cells surface expressing an anti-CD2 chimeric antigen receptor (CAR) fell within the outlined regions to the right of each plot; for example, LV129 showed low surface expression of the anti-CD2 CAR and LV123 showed relatively high surface expression of the anti-CD2 CAR. Measurements were taken at day 10 following transfection. The numbers within the outlined regions in each plot of FIGS. 7A-7E represent the percentage of total cells counted that were found to surface-express the anti-CD2 CAR ("CAR+) and, hence, fell within the outlined regions.

In FIGS. 8A-8E the notation "LV" followed by a number indicates a population of cells transduced with a lentiviral vector (LV) encoding the anti-CD2 CAR corresponding to the number (e.g., LV118 represents cells transduced using a lentiviral vector encoding pCAR_BTx118 ((SEQ ID NO: 754), see Table 20), "UTD" represents "untransduced cells" containing a CD2 gene that has been knocked out according to the methods provided herein using base editing, and "EP Only" represents "electroporation (EP) only" represents cells containing an unedited and functional CD2 gene and that have not been transduced with any lentiviral vector. The gating used for preparation of FIGS. 8A-8E was as follows: Gated on Singlets>Live>CD45+. Cells surface expressing CD2 fell outside the outlined regions to the left of each plot; for example, LV129 showed relatively high surface expression of CD2 and LV123 showed relatively low surface expression of the anti-CD2 CAR. Cell populations with high surface expression of the indicated anti-CD2 CAR correspondingly showed low to no surface expression of CD2. Thus, not being bound by theory, by comparing FIG. 8A-8E to FIGS. 7A-7E, it is demonstrated that the cell populations effectively expressing an anti-CD2 chimeric antigen receptor (CAR) self-purified for cells with CD2 expression knocked out. Measurements were taken at day 10 following transfection. FIG. 8F provides histograms corresponding to the flow cytometry plots of FIGS. 8A-8F. In FIG. 8F the order from top to bottom of the histograms presented in the figure correspond to the order in which descriptions of the histograms are presented in the Table (legend). In particular, in FIG. 8F the presented histograms, from top to bottom, respectively correspond to F2 (EP Only (no CD2 edit)), F1 (UTD), E6 (LV123 (no CD2 edit)), E5 (LV122 (no CD2 edit)), E4 (LV121 (no CD2 edit)), E3 (LV120 (no CD2 edit)), E2 (LV119 (no CD2 edit)), E1 (LV118 (no CD2 edit)), D12 (LV129 (CD2 edit)), D11 (LV128 (CD2 edit)), D10 (LV127 (CD2 edit)), D9 (LV126 (CD2 edit)), D8 (LV125 (CD2 edit)), D7 (LV124, (CD2 edit)), D6 (LV123 (CD2 edit)), D5 (LV122 (CD2 edit)), D4 (LV121 (CD2 edit)), D3 (LV120 (CD2 edit)), D2 (LV119 (CD2 edit)), D1 (LV118 (CD2 edit)). The numbers within the outlined regions in each plot of FIGS. 8A-8E represent the percentage of total cells counted that failed to surface-express CD2 ("CD2 negative") and, hence, fell within the outlined regions.

In FIG. 9 the notation "LV" followed by a number indicates a population of cells transduced with a lentiviral vector (LV) encoding the anti-CD2 CAR corresponding to the number (e.g., LV118 represents cells transduced using a lentiviral vector encoding pCAR_BTx118 ((SEQ ID NO: 754), see Table 20), "UTD" represents "untransduced cells," "CD2 Edit" indicates a cell population containing a CD2 gene knocked out according to the methods provided herein, and "No Edit" indicates a cell population containing functional CD2 genes that have not been knocked out according to the methods provided herein. Even numbered anti-CD2 CARs comprise only a CD2 costimulatory domain, and odd-numbered anti-CD2 CARs comprise only a CD28 costimulatory domain. Not being bound by theory, the comparatively large difference between edited ("CD2 Edit") and unedited ("No Edit") cells comprising the CD28 costimulatory domain-containing CARs is consistent with the CD28 costimulatory domain having a stronger costimulatory effect than corresponding CARs comprising the CD2 costimulatory domain.

In FIGS. 10A-10D the notation "LV" followed by a number indicates a population of cells transduced with a lentiviral vector (LV) encoding the anti-CD2 CAR corresponding to the number (e.g., LV118 represents cells transduced using a lentiviral vector encoding pCAR_BTx118 ((SEQ ID NO: 754), see Table 20), "CD2 Edit" indicates a cell population containing a CD2 gene knocked out according to the methods provided herein, and "No Edit" indicates a cell population containing functional CD2 genes that have not been knocked out according to the methods provided herein. The numbers within the outlined regions in each plot of FIGS. 10A-10D represent the percentage of total cells counted that were found to surface-express the anti-CD2 CAR ("CAR+) and, hence, fell within the outlined regions. The gating used for preparation of FIGS. 10A-10D was as follows: Gated on Singlets>Live. As can be seen from FIGS. 10A-10D, cell populations comprising functional CD2 genes and expressing the indicated CAR constructs committed fratricide by targeting and killing each other.

In FIGS. 11A-11D the notation "LV" followed by a number indicates a population of cells transduced with a lentiviral vector (LV) encoding the anti-CD2 CAR corresponding to the number (e.g., LV118 represents cells transduced using a lentiviral vector encoding pCAR_BTx118 ((SEQ ID NO: 754), see Table 20), "CD2 Edit" indicates a cell population containing a CD2 gene knocked out according to the methods provided herein, and "No Edit" indicates a cell population containing functional CD2 genes that have not been knocked out according to the methods provided herein. Live lymphocytes fell within the outlined region shown in each plot. The numbers within the outlined regions in each plot of FIGS. 11A-11D represent the percentage of total cells that were live lymphocytes and, hence, fell within the outlined regions. As can be seen from FIGS. 11A-11D, cell populations comprising functional CD2 genes and expressing the indicated CAR constructs committed fratricide by targeting and killing each other.

FIG. 12A shows that only anti-CD2 CAR-T cells exposed to the CD2+ Jurkat cells showed high levels of activation. FIG. 12B is an exploded view from FIG. 12A showing in more detail the low levels of tonic activation that were observed in the anti-CD2 CAR-T cells. In FIGS. 12A and 12B "UTD" represents untransduced cells.

DETAILED DESCRIPTION OF THE INVENTION

Figure 1:
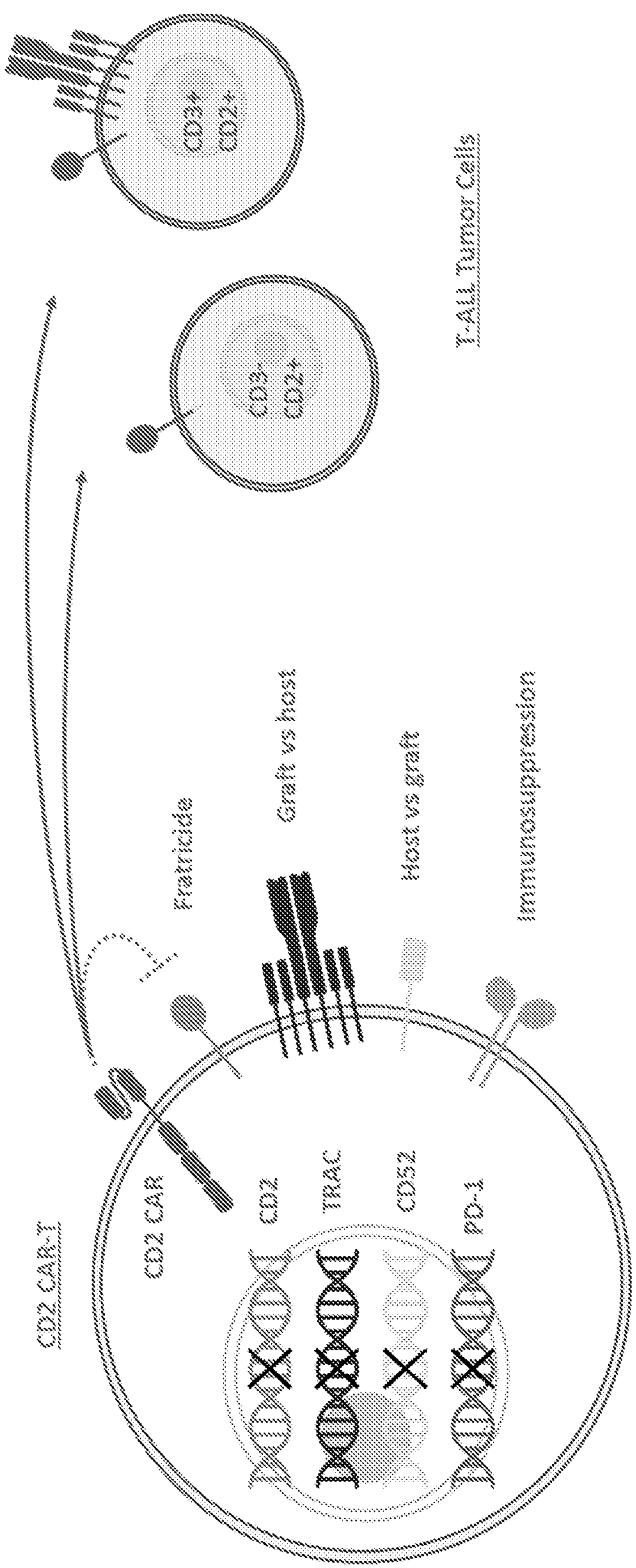
FIG. 1 is a schematic drawing of a fratricide resistant CD2 CAR-T useful for targeting T-ALL Tumor cells.

The present invention features genetically modified immune cells having enhanced anti-neoplasia activity and fratricide resistance. The present invention also features methods for producing and using these modified immune effector cells (e.g., T cells or NK cells).

The invention is based, at least in part, on the discovery that anti-CD2 CAR-T cells were activated in the presence of CD2+ cancer cells, but were resistant to fratricide.

The modification of immune effector cells to express chimeric antigen receptors and to knockout or knockdown specific genes to diminish the negative impact that their expression can have on immune cell function is accomplished using a base editor system comprising a cytidine deaminase or adenosine deaminase as described herein.

Autologous, patient-derived chimeric antigen receptor-T cell (CAR-T) therapies have demonstrated remarkable efficacy in treating some cancers. While these products have led to significant clinical benefit for patients, the need to generate individualized therapies creates substantial manufacturing challenges and financial burdens. Allogeneic CAR-T therapies were developed as a potential solution to these challenges, having similar clinical efficacy profiles to autologous products while treating many patients with cells derived from a single healthy donor, thereby substantially reducing cost of goods and lot-to-lot variability.

Most first-generation allogeneic CAR-Ts use nucleases to introduce two or more targeted genomic DNA double strand breaks (DSBs) in a target T cell population, relying on error-prone DNA repair to generate mutations that knock out target genes in a semi-stochastic manner. Such nuclease-based gene knockout strategies aim to reduce the risk of graft-versus-host-disease and host rejection of CAR-Ts. However, the simultaneous induction of multiple DSBs results in a final cell product containing large-scale genomic rearrangements such as balanced and unbalanced translocations, and a relatively high abundance of local rearrangements including inversions and large deletions. Furthermore, as increasing numbers of simultaneous genetic modifications are made by induced DSBs, considerable genotoxicity is observed in the treated cell population. This has the potential to significantly reduce the cell expansion potential from each manufacturing run, thereby decreasing the number of patients that can be treated per healthy donor.

Base editors (BEs) are a class of emerging gene editing reagents that enable highly efficient, user-defined modification of target genomic DNA without the creation of DSBs. Here, an alternative means of producing allogeneic CAR-T cells is proposed by using base editing technology to reduce or eliminate detectable genomic rearrangements while also improving cell expansion. In contrast to a nuclease-only editing strategy, concurrent modification of one or more, for example, one, two, three, four, five, six, seven, eight, night, ten, or more, genetic loci by base editing produces highly efficient gene knockouts with no detectable translocation events.

In some embodiments, at least one or more genes or regulatory elements thereof are modified in an immune cell with the base editing compositions and methods provided herein. In some embodiments, the at least one or more genes or regulatory elements thereof comprise one or more genes selected from CD2, TRAC, CD52, TRBC1, TRBC2, B2M, and CIITA and PD-1. In some embodiments, the at least one or more genes or regulatory elements thereof comprise one or more genes selected from CD5, TRAC, CD52, and PD-1. In some embodiments, the at least one or more genes or regulatory elements thereof comprise one or more genes selected from CD3, CD7, TRAC, CD52, and PD-1. In some embodiments, the at least one or more genes or regulatory elements thereof comprise one or more genes selected from TRAC, CD2, CD5, CD7, CD52, and PD-1. In some embodiments, the at least one or more genes or regulatory elements thereof are selected from ACAT1, ACLY, ADORA2A, AXL, B2M, BATF, BCL2L11, BTLA, CAMK2D, CAMP, CASP8, CBLB, CCR5, CD2, CD3D, CD3E, CD3G, CD4, CD5, CD7, CD8A, CD33, CD38, CD52, CD70, CD82, CD86, CD96, CD123, CD160, CD244, CD276, CDK8, CDKN1B, Chi311, CIITA, CISH, CSF2CSK, CTLA-4, CUL3, Cyp11a1, DCK, DGKA, DGKZ, DHX37, ELOB(TCEB2), ENTPD1 (CD39), FADD, FAS, GATA3, IL6, IL6R, IL10, IL10RA, IRF4, IRF8, JUNB, Lag3, LAIR-1 (CD305), LDHA, LIF, LYN, MAP4K4, MAPK14, MCJ, MEF2D, MGAT5, NR4A1, NR4A2, NR4A3, NTSE (CD73), ODC1, OTUL1NL (FAM105A), PAG1, PDCD1, PDIA3, PHD1 (EGLN2), PHD2 (EGLN1), PHD3 (EGLN3), PIK3CD, PIKFYVE, PPARa, PPARd, PRDMI1, PRKACA, PTEN, PTPN2, PTPN6, PTPN11, PVRIG (CD112R), RASA2, RFXANK, SELPG/PSGL1, SIGLEC15, SLA, SLAMF7, SOCS1, Spry1, Spry2, STK4, SUV39, H1TET2, TGFbRII, TIGIT, Tim-3, TMEM222, TNFAIP3, TNFRSF8 (CD30), TNFRSF10B, TOX, TOX2, TRAC, TRBC1, TRBC2, UBASH3A, VHL, VISTA, XBP1, YAP1, and ZC3H12A. Multiplex editing of genes may be useful in the creation of CAR-T cell therapies with improved therapeutic properties. This method addresses known limitations of multiplex-edited T cell products and are a promising development towards the next generation of precision cell-based therapies.

In one aspect, provided herein is a universal CAR-T cell. In some embodiments, the CAR-T cell described herein is an allogeneic cell. In some embodiments, the universal CAR-T cell is an allogeneic T cell that can be used to express a desired CAR, and can be universally applicable, irrespective of the donor and the recipient's immunogenic compatibility. An allogenic immune cell may be derived from one or more donors. In certain embodiments, the allogenic immune cell is derived from a single human donor. For example, the allogenic T cell may be derived from PBMCs of a single healthy human donor. In certain embodiments, the allogenic immune cell is derived from multiple human donors. In some embodiments, an universal CAR-T cell may be generated, as described herein by using gene modification to introduce concurrent edits at multiple gene loci, for example, three, four, five, six, seven, eight, nine, ten or more genetic loci. A modification, or concurrent modifications as described herein may be a genetic editing, such as a base editing, generated by a base editor. The base editor may be a C base editor or A base editor. As is discussed herein, base editing may be used to achieve a gene disruption, such that the gene is not expressed. A modification by base editing may be used to achieve a reduction in gene expression. In some embodiments base editor may be used to introduce a genetic modification such that the edited gene does not generate a structurally or functionally viable protein product. In some embodiments, a modification, such as the concurrent modifications described herein may comprise a genetic editing, such as base editing, such that the expression or functionality of the gene product is altered in any way. For example, the expression of the gene product may be enhanced or upregulated as compared to baseline expression levels. In some embodiments the activity or functionality of the gene product may be upregulated as a result of the base editing, or multiple base editing events acting in concert.

In some embodiments, generation of universal CAR-T cell may be advantageous over autologous T cell (CAR-T), which may be difficult to generate for an urgent use. Allogeneic approaches are preferred over autologous cell preparation for a number of situations related to uncertainty of engineering autologous T cells to express a CAR and finally achieving the desired cellular products for a transplant at the time of medical emergency. However, for allogeneic T cells, or "off-the-shelf" T cells, it is important to carefully negotiate the host's reactivity to the CAR-T cells (HVGD) as well as the allogeneic T cell's potential hostility towards a host cell (GVHD). Given the scenario, base editing can be successfully used to generate multiple simultaneous gene editing events, such that (a) it is possible to reduce or down regulate expression of antigens to generate a fratricide resistant immune cell; (b) it is possible to generate a platform cell type that is devoid of or expresses low amounts of an endogenous T cell receptor, for example, a TCR alpha chain (such a via base editing of TRAC), or a TCR beta chain (such a through base editing of TRBC1/TRBC2); and/or (c) it is possible to reduce or down regulate expression of antigens that may be incompatible to a host tissue system and vice versa.

In some embodiments, the methods described herein can be used to generate an autologous T cell expressing a CAR-T. In some embodiments, multiple base editing events can be accomplished in a single electroporation event, thereby reducing electroporation event associated toxicity Any known methods for incorporation of exogenous genetic material into a cell may be used to replace electroporation, and such methods known in the art are hereby contemplated for use in any of the methods described herein.

In some embodiments, a subject having or having a propensity to develop a neoplasia (e.g., T- or NK-cell malignancy) is administered an effective amount of a modified immune effector cell (e.g., CAR-T cell) that lacks or has reduced levels of CD2 and expresses a CD2 chimeric antigen receptor containing a CD2 co-stimulatory domain. In some embodiments, the CD2 modified immune cell administered to a subject is further modified in one or more genes or regulatory elements (e.g., CD52, TRAC, PD-1) with the base editing compositions and methods provided herein.

As shown herein, base editing in combination with a CAR insertion is a useful strategy for generating fratricide resistant allogeneic T cells with minimal genomic rearrangements. Multiplex editing of genes may also be useful in the creation of CAR-T cell therapies with improved therapeutic properties. This method addresses known limitations of CAR-T therapy and is a promising development towards the next generation of precision cell based therapies Editing of Target Genes Exemplary guide RNA spacers useful in the methods of the disclosure are described in the following Tables 1, 2A and 2B. In an embodiment, a gRNA molecule containing a spacer listed in Table 1 also contains an spCas9 scaffold. In various embodiments, the guide RNAs comprise a scaffold sequence described herein (e.g., an spCas9 scaffold sequence). In some embodiments, the guide RNA is designed to disrupt a splice site (i.e., a splice acceptor (SA) or a splice donor (SD). In some embodiments, the guide RNA is designed such that the base editing results in a premature STOP codon. Tables 1, 2A and 2B provide a non-exhaustive list of gRNA target sequences designed to disrupt a splice site or to result in a premature STOP codon.

TABLE 1

CD2 Guide RNA Spacer Sequences and Target Sequences

| Guide | Description | Target Sequence | Target SEQ ID NO | gRNA Spacer Sequence | Spacer SEQ ID NO | PAM |
|---|---|---|---|---|---|---|
| CD2 sgRNA1 | Exon 2 STOP (pos 8) | CTTGGGTCAGGACATCAACT | 558 | CUUGGGUCAGGACAUCAACU | 388 | NGG |
| CD2 sgRNA2 | Exon 2 STOP (pos 8) | CGATGATCAGGATATCTACA | 559 | CGAUGAUCAGGAUAUCUACA | 389 | NGG |
| CD2 sgRNA3 | Exon 3 SD (pos 7) | CACGCACCTGGACAGCTGAC | 560 | CACGCACCUGGACAGCUGAC | 390 | NGG |
| CD2 sgRNA4 | Exon 4 STOP (pos 4) | AAACAGAGGAGTCGGAGAAA | 561 | AAACAGAGGAGUCGGAGAAA | 391 | NGG |
| CD2 sgRNA5 | Exon 5 STOP (pos 4) | ACACAAGTTCACCAGCAGAA | 562 | ACACAAGUUCACCAGCAGAA | 392 | NGG |
| CD2 sgRNA6 | Exon 5 STOP (pos 4) | GTTCAGCCAAAACCTCCCCA | 563 | GUUCAGCCAAAACCUCCCCA | 393 | NGG |
| CD2 sgRNA7 | Exon 3 STOP (Pos 9) | ATACAAGTCCAGGAGATCTT | 564 | AUACAAGUCCAGGAGAUCUU | 394 | NGG |
| CD2 sgRNA8 | Exon 5 STOP (Pos 9) | TTCAGCACCAGCCTCAGAAG | 565 | UUCAGCACCAGCCUCAGAAG | 395 | NGG |

TABLE 2A gRNA Target Sequences and Spacer Sequences

| Gene | Description | Target sequence | Target SEQ ID NO | gRNA Spacer Sequence | Spacer SEQ ID NO |
|---|---|---|---|---|---|
| TRAC | Exon 1 STOP 1 (pos5) | GCTACAAACAAGCTCATCTT | 573 | GCUACAAACAAGCUCAUCUU | 403 |
| | Exon 1 STOP 2 (pos6) | CCAGCCAAGTACGTAAGTAG | 574 | CCAGCCAAGUACGUAAGUAG | 404 |
| | Exon 1 SA (pos9) | CTGGATATCTGTGGGACAAG | 575 | CUGGAUAUCUGUGGGACAAG | 405 |
| | Exon 1 SD | CTTACCTGGGCTGGGGAAGA | 576 | CUUACCUGGGCUGGGGAAGA | 406 |
| | Exon 3 SA | TTCGTATCTGTAAAACCAAG | 577 | UUCGUAUCUGUAAAACCAAG | 407 |
| | Exon 3 STOP | TTTCAAAACCTGTCAGTGAT | 578 | UUUCAAAACCUGUCAGUGAU | 408 |
| | Exon 3 STOP | TTCAAAACCTGTCAGTGATT | 579 | UUCAAAACCUGUCAGUGAUU | 409 |
| PDCD1/ PD-1 | Exon 1 STOP 2 (pos9) | ACGACTGGCCAGGGCGCCTG | 580 | ACGACUGGCCAGGGCGCCUG | 410 |
| | Exon 1 STOP 4 (pos7) | CACCGCCCAGACGACTGGCC | 581 | CACCGCCCAGACGACUGGCC | 411 |
| | Exon 1 STOP (pos4) | CTACAACTGGGCTGGCGGCC | 582 | CUACAACUGGGCUGGCGGCC | 412 |
| | Exon 1 SD | CACCTACCTAAGAACCATCC | 583 | CACCUACCUAAGAACCAUCC | 413 |
| | Exon 2 SA | GGAGTCTGAGAGATGGAGAG | 584 | GGAGUCUGAGAGAUGGAGAG | 414 |

TABLE 2A-continued gRNA Target Sequences and Spacer Sequences

| Gene | Description | Target sequence | Target SEQ ID NO | gRNA Spacer Sequence | Spacer SEQ ID NO |
|---|---|---|---|---|---|
| | Exon 2 STOP 1 (pos8) | CAGCAACCAGACGGACAAGC | 585 | CAGCAACCAGACGGACAAGC | 415 |
| | Exon 2 STOP 2 (pos9) | GTGTCACACAACTGCCCAAC | 586 | GUGUCACACAACUGCCCAAC | 416 |
| | Exon 3 STOP 1 (pos8) | AGCCGGCCAGTTCCAAACCC | 587 | AGCCGGCCAGUUCCAAACCC | 417 |
| | Exon 3 STOP (pos7) | CAGTTCCAAACCCTGGTGGT | 588 | CAGUUCCAAACCCUGGUGGU | 418 |
| | Exon 3 STOP 2 (pos5) | CGGCCAGTTCCAAACCCTGG | 589 | CGGCCAGUUCCAAACCCUGG | 419 |
| | Exon 3 STOP (pos5) | GGACCCAGACTAGCAGCACC | 590 | GGACCCAGACUAGCAGCACC | 420 |
| | Exon 3 SD | GACGTTACCTCGTGCGGCCC | 591 | GACGUUACCUCGUGCGGCCC | 421 |
| | Exon 4 SA | TCCCTGCAGAGAAACACACT | 592 | UCCCUGCAGAGAAACACACU | 422 |
| | Exon 4 SD | GAGACTCACCAGGGGCTGGC | 593 | GAGACUCACCAGGGGCUGGC | 423 |
| | Exon 5 SA | CCTCCTTCTTTGAGGAGAAA | 594 | CCUCCUUCUUUGAGGAGAAA | 424 |
| | Exon 2 STOP (pos7) | GGGGTTCCAGGGCCTGTCTG | 595 | GGGGUUCCAGGGCCUGUCUG | 425 |
| | Exon 3 SA | TTCTCTCTGGAAGGGCACAA | 596 | UUCUCUCUGGAAGGGCACAA | 426 |
| | Exon 5 STOP 1 (pos 8) | CCAGTGGCGAGAGAAGACCC | 597 | CCAGUGGCGAGAGAAGACCC | 427 |
| | Exon 5 STOP 2 (pos 5) | TGCCCAGCCACTGAGGCCTG | 598 | UGCCCAGCCACUGAGGCCUG | 428 |
| | Exon 1 STOP 1 (pos8) | CGACTGGCCAGGGCGCCTGT | 599 | CGACUGGCCAGGGCGCCUGU | 429 |
| | Exon 1 STOP 3 (pos6) | ACCGCCCAGACGACTGGCCA | 600 | ACCGCCCAGACGACUGGCCA | 430 |
| B2M (BE) | Exon 1 SD | ACTCACGCTGGATAGCCTCC | 566 | ACUCACGCUGGAUAGCCUCC | 396 |
| | Exon 2 SA (pos9) | TGGAGTACCTGAGGAATATC | 601 | UGGAGUACCUGAGGAAUAUC | 431 |
| | Exon 2 STOP (pos6) | TTACCCCACTTAACTATCTT | 602 | UUACCCCACUUAACUAUCUU | 432 |
| | Exon 3 SA | TCGATCTATGAAAAAGACAG | 603 | UCGAUCUAUGAAAAAGACAG | 433 |
| | Exon 2 STOP | TACCCCACTTAACTATCT | 604 | UACCCCACUUAACUAUCU | 434 |
| B2M (ABE) | Exon 1 SD 1 (pos5) | ACTCACGCTGGATAGCCTCC | 566 | ACUCACGCUGGAUAGCCUCC | 396 |
| | Exon 2 SA (pos 4) | CTCAGGTACTCCAAAGATTC | 605 | CUCAGGUACUCCAAAGAUUC | 435 |
| | Exon 2 SD (pos 4) | CTTACCCCACTTAACTATCT | 606 | CUUACCCCACUUAACUAUCU | 436 |
| CIITA | Exon 1 SD (pos 6) | TTTTACCTTGGGGCTCTGAC | 607 | UUUUACCUUGGGGCUCUGAC | 437 |
| | Exon 1 STOP 1 (pos 6) | AGCCCCAAGGTAAAAAGGCC | 608 | AGCCCCAAGGUAAAAAGGCC | 438 |
| | Exon 1 STOP 2 (pos 7) | GAGCCCCAAGGTAAAAAGGC | 609 | GAGCCCCAAGGUAAAAAGGC | 439 |
| | Exon 2 STOP 1 (pos 8) | CAGCTCACAGTGTGCCACCA | 610 | CAGCUCACAGUGUGCCACCA | 440 |
| | Exon 2 STOP 2 (pos 7) | TATGACCAGATGGACCTGGC | 611 | UAUGACCAGAUGGACCUGGC | 441 |
| | Exon 4 STOP 1 (pos 8) | ACTGGACCAGTATGTCTTCC | 612 | ACUGGACCAGUAUGUCUUCC | 442 |
| | Exon 4 STOP 2 (pos 8) | TGTCTTCCAGGACTCCCAGC | 613 | UGUCUUCCAGGACUCCCAGC | 443 |
| | Exon 7 STOP 1 (pos 7) | TTCAACCAGGAGCCAGCCTC | 614 | UUCAACCAGGAGCCAGCCUC | 44/ |
| | Exon 7 STOP 2 (pos 4) | GACCAGATTCCCAGTATGTT | 615 | GACCAGAUUCCCAGUAUGUU | 445 |
| | Exon 7 SD (pos 8) | TAACATACTGGGAATCTGGT | 616 | UAACAUACUGGGAAUCUGGU | 446 |
| | Exon 8 SA (pos 8) | AAAGGCACTGCAAGAGACAA | 617 | AAAGGCACUGCAAGAGACAA | 447 |

TABLE 2A-continued

| Gene | Description | Target sequence | Target SEQ ID NO | gRNA Spacer Sequence | Spacer SEQ ID NO |
|---|---|---|---|---|---|
| | gRNA Target Sequences and Spacer Sequences | | | | |
| | Exon 8 STOP (pos8) | CTCTGGCAAATCTCTG AGGC | 618 | CUCUGGCAAAUCUCUG AGGC | 448 |
| | Exon 9 STOP 1 (pos 4) | AGCCAAGTACCCCCTC CCAG | 619 | AGCCAAGUACCCCCUC CCAG | 449 |
| | Exon 9 STOP 2 (pos 7) | ACCTCCCGAGCAAACA TGAC | 620 | ACCUCCCGAGCAAACA UGAC | 450 |
| | Exon 9 SD (pos 6) | CCTTACCTGTCATGTT TGCT | 621 | CCUUACCUGUCAUGUU UGCU | 451 |
| | Exon 10 SA (pos5) | TGCTCTGGAGATGGAG AAGC | 622 | UGCUCUGGAGAUGGAG AAGC | 452 |
| | Exon 10 STOP 1 (pos 7) | CCCACCCAATGCCCGG CAGC | 623 | CCCACCCAAUGCCCGG CAGC | 453 |
| | Exon 10 STOP 2 (pos 4) | AGGCCATTTTGGAAGC TTGT | 624 | AGGCCAUUUUGGAAGC UUGU | 454 |
| | Exon 11 SA (pos8) | ACCGGCTCTGCAAAGG CCAG | 625 | ACCGGCUCUGCAAAGG CCAG | 455 |
| | Exon 11 STOP 1 (pos 6) | TGGTGCAGGCCAGGCT GGAG | 626 | UGGUGCAGGCCAGGCU GGAG | 456 |
| | Exon 11 STOP 3 (pos 7) | GAACGGCAGCTGGCCC AAGG | 627 | GAACGGCAGCUGGCCC AAGG | 457 |
| | Exon 11 STOP 4 (pos 5) | GGCCCAAGGAGGCCTG GCTG | 628 | GGCCCAAGGAGGCCUG GCUG | 458 |
| | Exon 11 STOP 5 (pos 5) | GACACGAGTGATTGCT GTGC | 629 | GACACGAGUGAUUGCU GUGC | 459 |
| | Exon 11 STOP 5 (pos 6) | CTGGTCAGGGCAAGAG CTAT | 630 | CUGGUCAGGGCAAGAG CUAU | 460 |
| | Exon 11 STOP 5 (pos 8) | GGGCCCACAGCCACTC GTGG | 631 | GGGCCCACAGCCACUC GUGG | 461 |
| | Exon 11 STOP 6 (pos 4) | TTCCAGAAGAAGCTGC TCCG | 632 | UUCCAGAAGAAGCUGC UCCG | 462 |
| | Exon 11 STOP 7 (pos 8) | CCTGGTCCAGAGCCTG AGCA | 633 | CCUGGUCCAGAGCCUG AGCA | 463 |
| | Exon 11 STOP 8 (pos 8) | CAGACATCAAAGTACC CTAC | 634 | CAGACAUCAAAGUACC CUAC | 464 |
| | Exon 11 STOP 9 (pos 5) | ACATCAAAGTACCCTA CAGG | 635 | ACAUCAAAGUACCCUA CAGG | 465 |
| | Exon 11 STOP 10 (pos 4) | CGCCCAGGTCCTCACG TCTG | 636 | CGCCCAGGUCCUCACG UCUG | 466 |
| | Exon 11 STOP 11 (pos 8) | CTTAGTCCAACACCCA CCGC | 637 | CUUAGUCCAACACCCA CCGC | 467 |
| | Exon 11 STOP 12 (pos 8) | CCTCCTGCAATGCTTC CTGG | 638 | CCUCCUGCAAUGCUUC CUGG | 468 |
| | Exon 11 STOP 13 (pos 8) | GAGCCAGCCACAGGGC CCCC | 639 | GAGCCAGCCACAGGGC CCCC | 469 |
| | Exon 11 STOP 14 (pos 6) | GGAAGCAGAAGGTGCT TGCG | 640 | GGAAGCAGAAGGUGCU UGCG | 470 |
| | Exon 11 STOP 15 (pos 6) | GGCTGCAGCCGGGGAC ACTG | 641 | GGCUGCAGCCGGGGAC ACUG | 471 |
| | Exon 11 STOP 16 (pos 4) | CTGCCAAATTCCAGCC TCCT | 642 | CUGCCAAAUUCCAGCC UCCU | 472 |
| | Exon 11 STOP 17 (pos 8) | GGCGGGCCAAGACTTC TCCC | 643 | GGCGGGCCAAGACUUC UCCC | 473 |
| | Exon 12 STOP 1 (pos 6) | AGACTCAGAGGTGAGA GGAG | 644 | AGACUCAGAGGUGAGA GGAG | 474 |
| | Exon 14 SA (pos4) | AGCCTAGGAGGCAAAG AGCA | 645 | AGCCUAGGAGGCAAAG AGCA | 475 |
| | Exon 14 STOP 1 (pos 5) | CCCCCAGGCTTTCCCC AAAC | 646 | CCCCCAGGCUUUCCCC AAAC | 476 |
| | Exon 14 SD (pos4) | TCACTCCAGATGCTGC AGGG | 647 | UCACUCCAGAUGCUGC AGGG | 477 |
| | Exon 15 SA (pos4) | AGGCTGCAGGTGGAAT CAGA | 648 | AGGCUGCAGGUGGAAU CAGA | 478 |
| | Exon 15 STOP 1 (pos 8) | CTTCCCCCAGCTGAAG TCCT | 649 | CUUCCCCCAGCUGAAG UCCU | 479 |
| | Exon 15 SD (pos7) | CACTCACTTGAGGGTT TCCA | 650 | CACUCACUUGAGGGUU UCCA | 480 |
| | Exon 16 SA (pos5) | CAGACTGCGGGGACAC AGTG | 651 | CAGACUGCGGGGACAC AGUG | 481 |
| | Exon 16 SD 1 (pos 8) | CCACTCACCTTAGCCT GAGC | 652 | CCACUCACCUUAGCCU GAGC | 482 |
| | Exon 16 SD 2 (pos 7) | CACTCACCTTAGCCTG AGCA | 653 | CACUCACCUUAGCCUG AGCA | 483 |
| | Exon 17 SA (pos8) | GTACAAGCTGTCGGAA ACAG | 654 | GUACAAGCUGUCGGAA ACAG | 484 |

TABLE 2A-continued

| qRNA Target Sequences and Spacer Sequences | | | | | |
|---|---|---|---|---|---|
| Gene | Description | Target sequence | Target SEQ ID NO | gRNA Spacer Sequence | Spacer SEQ ID NO |
| | Exon 17 SD 1 (pos 8) | ACACTCACTCCATCACCCGG | 655 | ACACUCACUCCAUCACCCGG | 485 |
| | Exon 17 SD 2 (pos 7) | CACTCACTCCATCACCCGGA | 656 | CACUCACUCCAUCACCCGGA | 486 |
| | Exon 18 STOP (pos 5) | CGTCCAGTACAACAAGTTCA | 657 | CGUCCAGUACAACAAGUUCA | 487 |
| | Exon 19 SA 1 (pos 8) | CCACATCCTGCAAGGGGGGA | 658 | CCACAUCCUGCAAGGGGGGA | 488 |
| | Exon 19 SA 2 (pos 7) | CACATCCTGCAAGGGGGGAT | 659 | CACAUCCUGCAAGGGGGGAU | 489 |
| | Exon 19 STOP 1 (pos 8) | TGGGCGTCCACATCCTGCAA | 660 | UGGGCGUCCACAUCCUGCAA | 490 |
| | Exon 19 STOP 2 (pos 7) | GGGCGTCCACATCCTGCAAG | 661 | GGGCGUCCACAUCCUGCAAG | 491 |
| | Exon 19 STOP 3 (pos 6) | GGCGTCCACATCCTGCAAGG | 662 | GGCGUCCACAUCCUGCAAGG | 492 |
| | Exon 19 STOP 4 (pos 5) | GCGTCCACATCCTGCAAGGG | 663 | GCGUCCACAUCCUGCAAGGG | 493 |
| CD7 | Exon 1 STOP (pos4) | GCCCAAGGTAAGAGCTTCCC | 664 | GCCCAAGGUAAGAGCUUCCC | 494 |
| | Exon 1 SD 1 (pos8) | GCTCTTACCTTGGGCAGCCA | 665 | GCUCUUACCUUGGGCAGCCA | 495 |
| | Exon 1 SD 2 (pos9) | AGCTCTTACCTTGGGCAGCC | 666 | AGCUCUUACCUUGGGCAGCC | 496 |
| | Exon 2 SA 1 (pos8) | TGCACCTCTGGGGAGGACCT | 667 | UGCACCUCUGGGGAGGACCU | 497 |
| | Exon 2 SA 2 (pos9) | CTGCACCTCTGGGGAGGACC | 668 | CUGCACCUCUGGGGAGGACC | 498 |
| | Exon 2 STOP 1 (pos 7) | CGCCTGCAGCTGTCGGACAC | 669 | CGCCUGCAGCUGUCGGACAC | 499 |
| | Exon 2 STOP 2 (pos 8) | CACCTGCCAGGCCATCACGG | 670 | CACCUGCCAGGCCAUCACGG | 500 |
| | Exon 2 SD 1 (pos6) | CCCTACCTGTCACCAGGACC | 671 | CCCUACCUGUCACCAGGACC | 501 |
| | Exon 2 SD 2 (pos5) | CCTACCTGTCACCAGGACCA | 672 | CCUACCUGUCACCAGGACCA | 502 |
| | Exon 3 SA (pos 4) | CCTCTGAGAAGGAAAAAAGA | 673 | CCUCUGAGAAGGAAAAAAGA | 503 |
| | Exon 3 STOP 1 (pos9) | CAGAGGAACAGTCCCAAGGA | 674 | CAGAGGAACAGUCCCAAGGA | 504 |
| CD52 | Exon 1 STOP (pos4) | GTACAGGTAAGAGCAACGCC | 675 | GUACAGGUAAGAGCAACGCC | 505 |
| | Exon 1 SD (pos7) | CTCTTACCTGTACCATAACC | 676 | CUCUUACCUGUACCAUAACC | 506 |
| | Exon 1 SD (pos 4) | TTACCTGTACCATAACCAGG | 677 | UUACCUGUACCAUAACCAGG | 507 |
| | Exon 2 SA (pos 6) | TGTATCTGTAGGAGGAGAAG | 678 | UGUAUCUGUAGGAGGAGAAG | 508 |
| | Exon 2 SA (pos 5) | GTATCTGTAGGAGGAGAAGT | 679 | GUAUCUGUAGGAGGAGAAGU | 509 |
| | Exon 2 STOP (pos7) | CAGATACAAACTGGACTCTC | 680 | CAGAUACAAACUGGACUCUC | 510 |
| CD2 | Exon 5 STOP 9(pos) | TTCAGCACCAGCCTCAGAAG | 565 | UUCAGCACCAGCCUCAGAAG | 395 |
| | Exon 3 STOP (pos9) | ATACAAGTCCAGGAGATCTT | 564 | AUACAAGUCCAGGAGAUCUU | 394 |
| | Exon 3 SD (pos 7) | CACGCACCTGGACAGCTGAC | 560 | CACGCACCUGGACAGCUGAC | 390 |
| | Ex3 STOP1 4(Pos) | TCTCAAAACCAAAGATCTCC | 681 | UCUCAAAACCAAAGAUCUCC | 511 |
| | Ex3 STOP2 (Pos6) | CAACACAACCCTGACCTGTG | 682 | CAACACAACCCUGACCUGUG | 512 |
| | Ex4 STOP (pos 4) | AAACAGAGGAGTCGGAGAAA | 561 | AAACAGAGGAGUCGGAGAAA | 391 |
| | Ex4 STOP2 (Pos5) | TCACCAAAAGGAAAAAACAG | 683 | UCACCAAAAGGAAAAAACAG | 513 |
| | Ex5 STOP (pos 4) | ACACAAGTTCACCAGCAGAA | 562 | ACACAAGUUCACCAGCAGAA | 392 |
| | ExS STOP (pos 4) | GTTCAGCCAAAACCTCCCCA | 563 | GUUCAGCCAAAACCUCCCCA | 393 |

TABLE 2A-continued qRNA Target Sequences and Spacer Sequences

| Gene | Description | Target sequence | Target SEQ ID NO | gRNA Spacer Sequence | Spacer SEQ ID NO |
|---|---|---|---|---|---|
| | Exon 2 STOP (pos8) | CTTGGGTCAGGACATCAACT | 558 | CUUGGGUCAGGACAUCAACU | 388 |
| | Exon 2 STOP 8(pos) | CGATGATCAGGATATCTACA | 559 | CGAUGAUCAGGAUAUCUACA | 389 |
| TRBC1 | Exon 1 STOP 1 (pos 8) | CCACACCCAAAAGGCCACAC | 567 | CCACACCCAAAAGGCCACAC | 397 |
| | Exon 1 STOP 2 (pos 5) | CCCACCAGCTCAGCTCCACG | 568 | CCCACCAGCUCAGCUCCACG | 398 |
| | Exon 1 STOP 3 (pos 7) | CGCTGTCAAGTCCAGTTCTA | 569 | CGCUGUCAAGUCCAGUUCUA | 399 |
| | Exon 1 STOP 4 (pos 6) | GCTGTCAAGTCCAGTTCTAC | 570 | GCUGUCAAGUCCAGUUCUAC | 400 |
| | Exon 1 STOP 5 (pos 5) | CACCCAGATCGTCAGCGCCG | 571 | CACCCAGAUCGUCAGCGCCG | 401 |
| | Exon 1 SD (pos 8) | CCACTCACCTGCTCTACCCC | 572 | CCACUCACCUGCUCUACCCC | 402 |
| | Exon 2 SA (pos 8) | CCACAGTCTGAAAGAAAGCA | 684 | CCACAGUCUGAAAGAAAGCA | 514 |
| | Exon 3 SA (pos 5) | GACACTGTTGGCACGGAGGA | 685 | GACACUGUUGGCACGGAGGA | 515 |
| | Exon 3 SD (pos 4) | TTACCATGGCCATCAACACA | 686 | UUACCAUGGCCAUCAACACA | 516 |
| TRBC2 | Exon 1 STOP 1 (pos 8) | CCACACCCAAAAGGCCACAC | 567 | CCACACCCAAAAGGCCACAC | 397 |
| | Exon 1 STOP 2 (pos 5) | CCCACCAGCTCAGCTCCACG | 568 | CCCACCAGCUCAGCUCCACG | 398 |
| | Exon 1 STOP 3 (pos 7) | CGCTGTCAAGTCCAGTTCTA | 569 | CGCUGUCAAGUCCAGUUCUA | 399 |
| | Exon 1 STOP 4 (pos 6) | GCTGTCAAGTCCAGTTCTAC | 570 | GCUGUCAAGUCCAGUUCUAC | 400 |
| | Exon 1 STOP 5 (pos 5) | CACCCAGATCGTCAGCGCCG | 571 | CACCCAGAUCGUCAGCGCCG | 401 |
| | Exon 2 SA (pos 8) | CCACAGTCTGAAAGAAAACA | 687 | CCACAGUCUGAAAGAAAACA | 517 |
| | Exon 2 SA (pos 7) | CACAGTCTGAAAGAAAACAG | 688 | CACAGUCUGAAAGAAAACAG | 518 |
| | Exon 3 SD (pos 4) | TTACCATGGCCATCAGCACG | 689 | UUACCAUGGCCAUCAGCACG | 519 |
| | Exon 1 SD (pos 8) | CCACTCACCTGCTCTACCCC | 572 | CCACUCACCUGCUCUACCCC | 402 |
| CD5 | Ex2 STOP 2 (pos6) | GGGTCATACCAGCTGAGCCG | 690 | GGGUCAUACCAGCUGAGCCG | 520 |
| | Ex3 SA (pos 8) | TGGAAATCTGGGGGTCAGAA | 691 | UGGAAAUCUGGGGGUCAGAA | 521 |
| | Ex3 SD (pos 9) | GTTACCCACCTAAGCAGGTC | 692 | GUUACCCACCUAAGCAGGUC | 522 |
| | Ex3 STOP (pos 6) | TCTGCCAGCGGCTGAACTGT | 693 | UCUGCCAGCGGCUGAACUGU | 523 |
| | Ex3 STOP (pos 5) | CTGCCAGCGGCTGAACTGTG | 694 | CUGCCAGCGGCUGAACUGUG | 524 |
| | Ex3 STOP (pos5/6) | CCTCCCACTGCTTGGAGCTC | 695 | CCUCCCACUGCUUGGAGCUC | 525 |
| | Ex3 STOP (pos 8) | GAAGTGCCAGGGCCAGCTGG | 696 | GAAGUGCCAGGGCCAGCUGG | 526 |
| | Ex3 STOP (pos8/9) | CCATGTGCCATCCGTCCTTG | 697 | CCAUGUGCCAUCCGUCCUUG | 527 |
| | Ex3 STOP (pos 9) | TTTGCAGCCAGAGCTGGGGC | 698 | UUUGCAGCCAGAGCUGGGGC | 528 |
| | Ex4 SA (pos 5) | GGTTCTGCAATGAGACACTC | 699 | GGUUCUGCAAUGAGACACUC | 529 |
| | Ex4 STOP (pos 4) | CTCCAGAGCCCACAGGTAAG | 700 | CUCCAGAGCCCACAGGUAAG | 53 |
| | Ex4 STOP2 (Pos5) | ACCACAACTCCAGAGCCCAC | 701 | ACCACAACUCCAGAGCCCAC | 531 |
| | Ex5 SA (pos 4) | GAGCTAGGAGAGGAGAGAGC | 702 | GAGCUAGGAGAGGAGAGAGC | 532 |
| | Ex5 SD (pos 9) | CTCACTTACCTGAGCAAAGG | 703 | CUCACUUACCUGAGCAAAGG | 533 |
| | Ex5 STOP (pos 5) | CTGCAGCTGGTGGCACAGTC | 704 | CUGCAGCUGGUGGCACAGUC | 534 |

TABLE 2A-continued qRNA Target Sequences and Spacer Sequences

| Gene | Description | Target sequence | Target SEQ ID NO | gRNA Spacer Sequence | Spacer SEQ ID NO |
|---|---|---|---|---|---|
| | Ex5 STOP (pos 7) | GATCTTCCATTGGATT GGCA | 705 | GAUCUUCCAUUGGAUU GGCA | 535 |
| | Ex5 STOP (pos 8) | TGAGGCCCAGGACAAG ACCC | 706 | UGAGGCCCAGGACAAG ACCC | 536 |
| | Ex6 SA (pos 5) | AAACCTGAGAGGGGAA GCAA | 707 | AAACCUGAGAGGGGAA GCAA | 537 |
| | Ex6 STOP (pos4/5 | CTCCCACCGCAGCGAG CTCC | 708 | CUCCCACCGCAGCGAG CUCC | 538 |
| | Ex6 STOP (pos 5) | TTTCCAGCCCAAGGTG CAGA | 709 | UUUCCAGCCCAAGGUG CAGA | 539 |
| | Ex6 STOP (pos 5) | GGTGCAGAGCCGTCTG GTGG | 710 | GGUGCAGAGCCGUCUG GUGG | 540 |
| | Ex6 STOP (pos 6) | AGGTGCAGAGCCGTCT GGTG | 711 | AGGUGCAGAGCCGUCU GGUG | 541 |
| | Ex6 STOP (pos 7) | TCCTATCGAGTGCTGG ACGC | 712 | UCCUAUCGAGUGCUGG ACGC | 542 |
| | Ex6 STOP (pos 7) | AAGGTGCAGAGCCGTC TGGT | 713 | AAGGUGCAGAGCCGUC UGGU | 543 |
| | Ex6 STOP (pos 8) | CAAGGTGCAGAGCCGT CTGG | 714 | CAAGGUGCAGAGCCGU CUGG | 544 |
| | Ex6 STOP (pos8/9 | GGGCTGCCCACTGAGC CCCC | 715 | GGGCUGCCCACUGAGC CCCC | 545 |
| | Ex6 STOP (pos 9) | AGGTGCGCCAGGGGGC TCAG | 716 | AGGUGCGCCAGGGGGC UCAG | 546 |
| | Ex7 STOP (pos 4) | GGCCAGGATCCAAACC CCGC | 717 | GGCCAGGAUCCAAACC CCGC | 547 |
| | Ex8 STOP (pos 4) | CGCCAGTGGATTGGCC CAAC | 718 | CGCCAGUGGAUUGGCC CAAC | 548 |
| | Ex8 STOP (pos 5) | GCGCCAGTGGATTGGC CCAA | 719 | GCGCCAGUGGAUUGGC CCAA | 549 |
| | Ex8 STOP (pos 7) | AAGAAGCAGCGCCAGT GGAT | 720 | AAGAAGCAGCGCCAGU GGAU | 550 |
| | Ex9 SD (pos 6) | GCTTACCTGGATAAGC TGAC | 721 | GCUUACCUGGAUAAGC UGAC | 551 |
| | Ex9 SD1 (Pos 8) | AAAGACACTGGGCAGA TGGT | 722 | AAAGACACUGGGCAGA UGGU | 552 |
| | Ex10 SA (pos 9) | TTCCAGAGCTGGGGAA AGAA | 723 | UUCCAGAGCUGGGGAA AGAA | 553 |
| | Exon 1 SD (pos 6) | ACTCACCCAGCATCCC CAGC | 724 | ACUCACCCAGCAUCCC CAGC | 554 |
| | Exon 2 SA (pos 6) | AGCGACTGCAGAAAGA AGAG | 725 | AGCGACUGCAGAAAGA AGAG | 555 |
| | Exon 2 STOP (pos5/6) | CATACCAGCTGAGCCG TCCG | 726 | CAUACCAGCUGAGCCG UCCG | 556 |

TABLE 2B

| gRNA Target Sequences and Spacer Sequences | | | | | | | | |
|---|---|---|---|---|---|---|---|---|
| Gene | gRNA Name | Target Sequence | Target SEQ ID NO | Spacer Sequence | Spacer SEO ID NO | Orientation | Target base(s) | Predicted Outcome |
| PDCD1 | Ex. 1 SD | CACCTACCTAAGAACCATCC | 583 | CACCUACCUAAGAACCAUCC | 413 | Antisense | C7 | Splice donor disruption: GT → AT |
| PDCD1 | Ex. 2 SA | GGAGTCTGAGAGATGGAGAG | 584 | GGAGUCUGAGAGAUGGAGAG | 414 | Antisense | C6 | Splice acceptor disruption: AG → AA |
| PDCD1 | Ex. 3 SA | TTCTCTCTGGAAGGGCACAA | 596 | UUCUCUCUGGAAGGGCACAA | 426 | Antisense | C7 | Splice acceptor disruption: AG → AA |
| PDCD1 | Ex. 3 SD | GACGTTACCTCGTGCGGCCC | 591 | GACGUUACCUCGUGCGGCCC | 421 | Antisense | C8 | Splice donor disruption: GT → AT |
| PDCD1 | Ex. 4 SA | CCTGCAGAGAAACACACTTG | 727 | CCUGCAGAGAAACACACUUG | 557 | Antisense | C2 | Splice acceptor disruption; AG → AA |
| PDCD1 | Ex. 2 pmSTOP | GGGGTTCCAGGGCCTGTCTG | 595 | GGGGUUCCAGGGCCUGUCUG | 425 | Antisense | C7, C8 | pmSTOP induction: TGG (Trp) → TAG, TGA, TAA |
| PDCD1 | Ex. 3 pmSTOP_1 | CAGTTCCAAACCCTGGTGGT | 588 | CAGUUCCAAACCCUGGUGGU | 418 | Sense | C7 | pmSTOP induction: CAA (Gln) → TAA |
| PDCD1 | Ex. 3 pmSTOP_2 | GGACCCAGACTAGCAGCACC | 590 | GGACCCAGACUAGCAGCACC | 420 | Antisense | C5, C6 | pmSTOP induction: TGG (Trp) → TAG, TGA, TAA |

TABLE 2B-continued

| gRNA Target Sequences and Spacer Sequences | | | | | | | | |
|---|---|---|---|---|---|---|---|---|
| Gene | gRNA Name | Target Sequence | Target SEQ ID NO | Spacer Sequence | Spacer SEO ID NO | Orientation | Target base(s) | Predicted Outcome |
| TRAC | Ex. 1 SD | CTTACCTGGGCTGGGGAAGA | 576 | CUUACCUGGGCUGGGGAAGA | 406 | Antisense | C5 | Splice donor disruption: GT → AT |
| TRAC | Ex. 3 SA | TTCGTATCTGTAAAACCAAG | 577 | UUCGUAUCUGUAAAACCAAG | 407 | Antisense | C8 | Splice acceptor disruption: AG → AA |
| TRAC | Ex. 3 pmSTOP_1 | TTTCAAAACCTGTCAGTGAT | 578 | UUUCAAAACCUGUCAGUGAU | 408 | Sense | C4 | pmSTOP induction: CAA (Gln) → TAA |
| TRAC | Ex. 3 pmSTOP_2 | TTCAAAACCTGTCAGTGATT | 579 | UUCAAAACCUGUCAGUGAUU | 409 | Sense | C3 | pmSTOP induction: CAA (Gln) → TAA |

To produce the gene edits described above, T cells or NK cells are collected from a subject and contacted with two or more guide RNAs and a nucleobase editor polypeptide comprising a nucleic acid programmable DNA binding protein (napDNAbp) and a cytidine deaminase or adenosine deaminase. Alternatively, the cells can be any cell type or cell line known in the art, including immune cells (e.g., the T- or NK-cells), or immortalized human cell lines, such as 293T, K562 or U20S. Alternatively, primary cells (e.g., human) may be used. Cells may also be obtained from a tissue biopsy, surgery, blood, plasma, serum, or other biological fluid. In some embodiments, cells to be edited are contacted with at least one nucleic acid, wherein the at least one nucleic acid encodes two or more guide RNAs and a nucleobase editor polypeptide comprising a nucleic acid programmable DNA binding protein (napDNAbp) and a cytidine deaminase. In some embodiments, the gRNA comprises nucleotide analogs. These nucleotide analogs can inhibit degradation of the gRNA from cellular processes. Tables 1, 2A and 2B provide target sequences to be used for gRNAs.

Nucleobase Editors

Useful in the methods and compositions described herein are nucleobase editors that edit, modify or alter a target nucleotide sequence of a polynucleotide. Nucleobase editors described herein typically include a polynucleotide programmable nucleotide binding domain and a nucleobase editing domain (e.g., adenosine deaminase or cytidine deaminase). A polynucleotide programmable nucleotide binding domain, when in conjunction with a bound guide polynucleotide (e.g., gRNA), can specifically bind to a target polynucleotide sequence and thereby localize the base editor to the target nucleic acid sequence desired to be edited.

In certain embodiments, the nucleobase editors provided herein comprise one or more features that improve base editing activity. For example, any of the nucleobase editors provided herein may comprise a Cas9 domain that has reduced nuclease activity. In some embodiments, any of the nucleobase editors provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand opposite the targeted nucleobase. Mutation of the catalytic residue (e.g., D10 to A10) prevents cleavage of the edited (e.g., deaminated) strand containing the targeted residue (e.g., A or C). Such Cas9 variants can generate a single-strand DNA break (nick) at a specific location based on the gRNA-defined target sequence, leading to repair of the non-edited strand, ultimately resulting in a nucleobase change on the non-edited strand.

Polynucleotide Programmable Nucleotide Binding Domain

Polynucleotide programmable nucleotide binding domains bind polynucleotides (e.g., RNA, DNA). A polynucleotide programmable nucleotide binding domain of a base editor can itself comprise one or more domains (e.g., one or more nuclease domains). In some embodiments, the nuclease domain of a polynucleotide programmable nucleotide binding domain can comprise an endonuclease or an exonuclease. An endonuclease can cleave a single strand of a double-stranded nucleic acid or both strands of a double-stranded nucleic acid molecule. In some embodiments, a nuclease domain of a polynucleotide programmable nucleotide binding domain can cut zero, one, or two strands of a target polynucleotide.

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some embodiments, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid Such a protein is referred to herein as a "CRISPR protein." Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1 (e.g., SEQ ID NO: 232), Cas12c/C2c3, Cas12d/CasY, Cas12e/CasX, Cas12g, Cas12h, Cas12i, and Cas12j/Cas•, CARF, DinG, homologues thereof, or modified versions thereof. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. A Cas protein (e.g., Cas9, Cas12) or a Cas domain (e.g., Cas9, Cas12) can refer to a polypeptide or domain with at least or at least about 50%, 60%, 70%, 80%, 90%, 91%, 92%, 93%, 94%, 95%, 96%, 97%, 98%, 99%, or 100% sequence identity and/or sequence homology to a wild-type exemplary Cas polypeptide or Cas domain. Cas (e.g., Cas9, Cas12) can refer to the wild-type or a modified form of the Cas protein that can comprise an amino acid change such as a deletion, insertion, substitution, variant, mutation, fusion, chimera, or any combination thereof. In some embodiments, a CRISPR protein-derived domain of a base editor can include all or a portion of Cas9 from *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense*

(NCBI Ref: NC_021846.1); *Streptococcus iniae* (NCBI Ref: NC_021314.1); *Belliella baltica* (NCBI Ref: NC_018010.1); *Psychroflexus torquis* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Neisseria meningitidis* (NCBI Ref: YP_002342100.1), *Streptococcus pyogenes*, or *Staphylococcus aureus*.

Cas9 nuclease sequences and structures are well known to those of skill in the art (See, e.g., "Complete genome sequence of an Ml strain of *Streptococcus pyogenes*." Ferretti et al., *Proc. Natl. Acad. Sci. U.S.A.* 98:4658-4663 (2001); "CRISPR RNA maturation by trans-encoded small RNA and host factor RNase III." Deltcheva E., et al., Nature 471:602-607 (2011); and "A programmable dual-RNA-guided DNA endonuclease in adaptive bacterial immunity." Jinek M., et al., *Science* 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

High Fidelity Cas9 Domains

Some aspects of the disclosure provide high fidelity Cas9 domains. High fidelity Cas9 domains are known in the art and described, for example, in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each of which are incorporated herein by reference. An Exemplary high fidelity Cas9 domain is provided in the Sequence Listing as SEQ ID NO: 233. In some embodiments, high fidelity Cas9 domains are engineered Cas9 domains comprising one or more mutations that decrease electrostatic interactions between the Cas9 domain and the sugar-phosphate backbone of a DNA, relative to a corresponding wild-type Cas9 domain. High fidelity Cas9 domains that have decreased electrostatic interactions with the sugar-phosphate backbone of DNA have less off-target effects. In some embodiments, the Cas9 domain (e.g., a wild type Cas9 domain (SEQ ID NOs: 197 and 200) comprises one or more mutations that decrease the association between the Cas9 domain and the sugar-phosphate backbone of a DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a D10A, N497X, a R661X, a Q695X, and/or a Q926X mutation, or a corresponding mutation in any of the amino acid sequences provided herein, wherein X is any amino acid. In some embodiments, the high fidelity Cas9 enzyme is SpCas9 (K855A), eSpCas9 (1.1), SpCas9-HF1, or hyper accurate Cas9 variant (HypaCas9). In some embodiments, the modified Cas9 eSpCas9 (1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9.

Cas9 Domains with Reduced Exclusivity

Typically, Cas9 proteins, such as Cas9 from *S. pyogenes* (spCas9), require a "protospacer adjacent motif (PAM)" or PAM-like motif, which is a 2-6 base pair DNA sequence immediately following the DNA sequence targeted by the Cas9 nuclease in the CRISPR bacterial adaptive immune system. The presence of an NGG PAM sequence is required to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" *Nature* 533, 420-424 (2016), the entire contents of which are hereby incorporated by reference. Exemplary polypeptide sequences for spCas9 proteins capable of binding a PAM sequence are provided in the Sequence Listing as SEQ ID NOs: 197, 201, and 234-237. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

Nickases

In some embodiments, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g., DNA). In some embodiments, a nickase can be derived from a fully catalytically active (e.g., natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such embodiments, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g., natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

In some embodiments, wild-type Cas9 corresponds to, or comprises the following amino acid sequence:

(SEQ ID NO: 197)

MDKKySIGLDIGTNSVGWAVITDEYKVPSKKFKVLGNTDRHSIKKNLIGA

LLEDSGEtAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMINFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGdSLHEHIANLAGSPAIKKGILQTVKVVDELVKV

MGRHKPENIVIEMaRENQTTQKGQKNSRERMKRIEEGIKELGSQILKEHP

VENTQLQNEKLYLYYLQNGRDMYVDQELDINRLSDYDVDHIVPQSFLKDD

SIDNKVLIRSDKNRGKSDNVPSEEVVKKMKNYWRQLLNAKLITQRKFDNL

TKAERGgLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QtGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

-continued

PIREQAENIIHLFTLINLGAPAAFKYFDTTIDRKRYTSTKEVLDATLIHQ

SITGLYETRIDLSQLGGD (single underline: HNH domain; double underline: RuvC domain).

In some embodiments, the strand of a nucleic acid duplex target polynucleotide sequence that is cleaved by a base editor comprising a nickase domain (e.g., Cas9-derived nickase domain, Cas12-derived nickase domain) is the strand that is not edited by the base editor (i.e., the strand that is cleaved by the base editor is opposite to a strand comprising a base to be edited). In other embodiments, a base editor comprising a nickase domain (e.g., Cas9-derived nickase domain, Cas12-derived nickase domain) can cleave the strand of a DNA molecule which is being targeted for editing. In such embodiments, the non-targeted strand is not cleaved.

In some embodiments, a Cas9 nuclease has an inactive (e.g., an inactivated) DNA cleavage domain, that is, the Cas9 is a nickase, referred to as an "nCas9" protein (for "nickase" Cas9). The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

The amino acid sequence of an exemplary catalytically Cas9 nickase (nCas9) is as follows:

(SEQ ID NO: 201)

MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

-continued

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYEDTTIDRKRYTSTKEVLD

ATLIHQSITGLYETRIDLSQLGGD

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (• 3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some embodiments, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., (b+c)/(a+b+c), where "a" is the band intensity of DNA substrate and "b" and "c" are the cleavage products).

In some embodiments, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2})\times100$, where "a" is the band intensity of DNA substrate and "b" and "c" are the cleavage products (Ran et. al., *Cell.* 2013 Sep. 12; 154 (6): 1380-9; and Ran et al., *Nat Protoc.* 2013 November; 8 (11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most embodiments, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

Catalytically Dead Nucleases

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g., RuvC1 and/or HNH domains). In further embodiments, a catalytically dead polynucleotide programmable nucleotide binding domain comprises a point mutation (e.g., D10A or H840A) as well as a deletion of all or a portion of a nuclease domain. dCas9 domains are known in the art and described, for example, in Qi et al., "Repurposing CRISPR as an RNA-guided platform for sequence-specific control of gene expression." *Cell.* 2013; 152 (5): 1173-83, the entire contents of which are incorporated herein by reference.

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31 (9): 833-838, the entire contents of which are incorporated herein by reference).

In some embodiments, dCas9 corresponds to, or comprises in part or in whole, a Cas9 amino acid sequence having one or more mutations that inactivate the Cas9 nuclease activity. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. In some embodiments, a nuclease-inactive Cas9 domain comprises the amino acid sequence set forth in Cloning vector pPlatTET-gRNA2 (Accession No. BAV54124).

In some embodiments, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., *Science* 2012 Aug. 17, 337 (6096): 816-21).

In some embodiments, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs) As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

As another non-limiting example, in some embodiments, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some embodiments, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such embodiments, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided in the Sequence Listing submitted herewith.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNGRRV PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

In some embodiments, one of the Cas9 domains present in the fusion protein may be replaced with a guide nucleotide sequence-programmable DNA-binding protein domain that has no requirements for a PAM sequence. In some embodiments, the Cas9 is an SaCas9. Residue A579 of SaCas9 can be mutated from N579 to yield a SaCas9 nickase. Residues K781, K967, and H1014 can be mutated from E781, N967, and R1014 to yield a SaKKH Cas9.

In some embodiments, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' was used.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3•overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9.

Furthermore, Cpf1, unlike Cas9, does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins that are more similar to types I and III than type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' or 5'-TTN-3' in contrast to the G-rich PAM targeted by Cas9. After identification of PAM, Cpf1 introduces a sticky-end-like DNA double-stranded break having an overhang of 4 or 5 nucleotides.

In some embodiments, the Cas9 is a Cas9 variant having specificity for an altered PAM sequence. In some embodiments, the Additional Cas9 variants and PAM sequences are described in Miller, S. M., et al. Continuous evolution of SpCas9 variants compatible with non-G PAMs, Nat. Biotechnol. (2020), the entirety of which is incorporated herein by reference. in some embodiments, a Cas9 variate have no specific PAM requirements. In some embodiments, a Cas9 variant, e.g. a SpCas9 variant has specificity for a NRNH PAM, wherein R is A or G and His A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 or a corresponding position thereof. In some embodiments, the SpCas9 variant comprises an amino acid substitution at position 1114, 1135, 1218, 1219, 1221, 1249, 1320, 1321, 1323, 1332, 1333, 1335, or 1337 or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 or a corresponding position thereof. Exemplary amino acid substitutions and PAM specificity of SpCas9 variants are shown in Tables 3A-3D.

TABLE 3A

| SpCas9 Variants and PAM specificity | | | | | | | | | | | | | |
|---|---|---|---|---|---|---|---|---|---|---|---|---|---|
| | SpCas9 amino acid position | | | | | | | | | | | | |
| PAM | 1114 R | 1135 D | 1218 G | 1219 E | 1221 Q | 1249 P | 1320 A | 1321 P | 1323 A | 1332 D | 1333 R | 1335 R | 1337 T |
| AAA | | N | | V | H | | | | | | G | | |
| AAA | | N | | V | H | | | | | | G | | |
| AAA | | | | V | | | | | | | G | | |
| TAA | G | N | | V | | | | | | | I | | |
| TAA | | N | | V | | | | | | | I | | A |
| TAA | G | N | | V | | | | | | | I | | A |
| CAA | | | | V | | | | | | | K | | |
| CAA | | N | | V | | | | | | | K | | |
| CAA | | N | | V | | | | | | | K | | |
| GAA | | | | V | H | | V | | | | K | | |
| GAA | | N | | V | | | V | | | | K | | |
| GAA | | | | V | H | | V | | | | K | | |
| TAT | | | S | V | H | S | | S | | | | L | |
| TAT | | | S | V | H | S | | S | | | | L | |
| TAT | | | S | V | H | S | | S | | | | L | |
| GAT | | | | V | | | | | | | I | | |
| GAT | | | | V | | | | | D | | | Q | |
| GAT | | | | V | | | | | D | | | Q | |
| CAC | | | | V | | | | | | N | | Q | N |
| CAC | | N | | V | | | | | | | | Q | N |
| CAC | | | | V | | | | | | N | | Q | N |

TABLE 3B

| SpCas9 Variants and PAM specificity | | | | | | | | | | | | | | | | | | | |
|---|---|---|---|---|---|---|---|---|---|---|---|---|---|---|---|---|---|---|---|
| | SpCas9 amino acid position | | | | | | | | | | | | | | | | | | |
| PAM | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
| GAA | | | | | | | | | | V | H | | | | | | V | | K |
| GAA | | | N | S | | | | | | V | | | | | | | V | D | K |
| GAA | | | N | | | | | | | V | H | | Y | | | | V | | K |
| CAA | | | N | | | | | | | V | H | | Y | | | | V | | K |
| CAA | G | | N | S | | | | | | V | H | | Y | | | | V | | K |
| CAA | | | N | | | | | R | | V | H | | | | | | V | | K |
| CAA | | | N | | | | G | | R | V | H | | Y | | | | V | | K |
| CAA | | | N | | | | | | | V | H | | Y | | | | V | | K |
| AAA | | | N | | | | G | | | V | H | R | Y | | | | V | D | K |
| CAA | G | | N | | | | G | | | V | H | | Y | | | | V | D | K |
| CAA | | L | N | | | | G | | | V | H | | Y | | | T | V | D | K |
| TAA | G | | N | | | | G | | | V | H | | Y | G | S | | V | D | K |
| TAA | G | | N | | | E | G | | | V | H | | Y | | S | | V | | K |
| TAA | G | | N | | | | G | | | V | H | | Y | | S | | V | D | K |
| TAA | G | | N | | | | G | | R | V | H | | | | | | V | | K |

TABLE 3B-continued

SpCas9 Variants and PAM specificity

| | SpCas9 amino acid position | | | | | | | | | | | | | | | | | | |
|---|---|---|---|---|---|---|---|---|---|---|---|---|---|---|---|---|---|---|---|
| PAM | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
| TAA | | | N | | | | G | | R | V | H | | Y | | | | V | | K |
| TAA | G | | N | | A | | G | | | V | H | | | | | | V | | K |
| TAA | G | | N | | | | | | | V | H | | | | | | V | | K |

TABLE 3C

SpCas9 Variants and PAM specificity

| | SpCas9 amino acid position | | | | | | | | | |
|---|---|---|---|---|---|---|---|---|---|---|
| PAM | 1114 R | 1131 Y | 1135 D | 1150 E | 1156 K | 1180 D | 1191 K | 1218 G | 1219 E | 1221 Q |
| SacB.TAT | | | N | | | | N | | V | H |
| SacB.TAT | | | N | | | | | S | V | H |
| AAT | | | N | | | | | S | V | H |
| TAT | G | | N | | | G | | S | V | H |
| TAT | G | | N | | | G | | S | V | H |
| TAT | G | C | N | | | G | | S | V | H |
| TAT | G | C | N | | | G | | S | V | H |
| TAT | G | C | N | | | G | | S | V | H |
| TAT | G | C | N | | E | G | | S | V | H |
| TAT | G | C | N | V | | G | | S | V | H |
| TAT | | C | N | | | G | | S | V | H |
| TAT | G | C | N | | | G | | S | V | H |

| | SpCas9 amino acid position | | | | | | | | | |
|---|---|---|---|---|---|---|---|---|---|---|
| PAM | 1227 A | 1249 P | 1253 E | 1286 N | 1293 A | 1320 A | 1321 P | 1332 D | 1335 R | 1339 T |
| SacB.TAT | | | | | | V | S | | L | |
| SacB.TAT | | S | | | | | S | G | L | |
| AAT | V | S | | K | T | | S | G | L | I |
| TAT | | S | K | | | | S | G | L | |
| TAT | | | | | | | S | G | L | |
| TAT | | | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |

TABLE 3D

SpCas9 Variants and PAM specificity

| | SpCas9 amino acid position | | | | | | | | | | | | | |
|---|---|---|---|---|---|---|---|---|---|---|---|---|---|---|
| PAM | 1114 R | 1127 D | 1135 D | 1180 D | 1207 E | 1219 E | 1234 N | 1286 N | 1301 P | 1332 D | 1335 R | 1337 T | 1338 S | 1349 H |
| SacB.CAC | | | N | | | V | | | | N | Q | N | | |
| AAC | G | | N | | | V | | | | N | Q | N | | |
| AAC | G | | N | | | V | | | | N | Q | N | | |
| TAC | G | | N | | | V | | | | N | Q | N | | |
| TAC | G | | N | | | V | | H | | N | Q | N | | |
| TAC | G | | N | | G | V | D | H | | N | Q | N | | |
| TAC | G | | N | | | V | | | | N | Q | N | | |
| TAC | G | G | N | E | | V | | H | | N | Q | N | | |
| TAC | G | | N | | | V | | H | | N | Q | N | | |
| TAC | G | | N | | | V | | | | N | Q | N | T | R |

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60 (3): 385-397, the entire contents of which is hereby incorporated by reference. Effectors of two of the systems, Cas12b/C2c1, and Cas12c/C2c3, contain RuvC-like endonuclease domains related to Cpf1. A third system contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

In some embodiments, the napDNAbp is a circular permutant (e.g., SEQ ID NO: 238).

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65 (2): 310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167 (7): 1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

In some embodiments, a napDNAbp refers to Cas12c. In some embodiments, the Cas12c protein is a Cas12c1 (SEQ ID NO: 239) or a variant of Cas12c1. In some embodiments, the Cas12 protein is a Cas12c2 (SEQ ID NO: 240) or a variant of Cas12c2. In some embodiments, the Cas12 protein is a Cas12c protein from *Oleiphilus* sp. HI0009 (i.e., OspCas12c, SEQ ID NO. 241) or a variant of OspCas12c. These Cas12c molecules have been described in Yan et al., "Functionally Diverse Type V CRISPR-Cas Systems," Science, 2019 Jan. 4; 363:88-91; the entire contents of which is hereby incorporated by reference. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12c1, Cas12c2, or OspCas12c protein. In some embodiments, the napDNAbp is a naturally-occurring Cas12c1, Cas12c2, or OspCas12c protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12c1, Cas12c2, or OspCas12c protein described herein. It should be appreciated that Cas12c1, Cas12c2, or OspCas12c from other bacterial species may also be used in accordance with the present disclosure.

In some embodiments, a napDNAbp refers to Cas12g, Cas12h, or Cas12i, which have been described in, for example, Yan et al., "Functionally Diverse Type V CRISPR-Cas Systems," Science, 2019 Jan. 4; 363:88-91; the entire contents of each is hereby incorporated by reference. Exemplary Cas12g, Cas12h, and Cas12i polypeptide sequences are provided in the Sequence Listing as SEQ ID NOs: 242-245. By aggregating more than 10 terabytes of sequence data, new classifications of Type V Cas proteins were identified that showed weak similarity to previously characterized Class V protein, including Cas12g, Cas12h, and Cas12i. In some embodiments, the Cas12 protein is a Cas12g or a variant of Cas12g. In some embodiments, the Cas12 protein is a Cas12h or a variant of Cas12h. In some embodiments, the Cas12 protein is a Cas12i or a variant of Cas12i. It should be appreciated that other RNA-guided DNA binding proteins may be used as a napDNAbp, and are within the scope of this disclosure. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12g, Cas12h, or Cas12i protein. In some embodiments, the napDNAbp is a naturally-occurring Cas12g, Cas12h, or Cas12i protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12g, Cas12h, or Cas12i protein described herein. It should be appreciated that Cas12g, Cas12h, or Cas12i from other bacterial species may also be used in accordance with the present disclosure. In some embodiments, the Cas12i is a Cas12i1 or a Cas12i2.

In some embodiments, the nucleic acid programmable DNA binding protein (napDNAbp) of any of the fusion proteins provided herein may be a Cas12j/Cas• protein. Cas12j/Cas• is described in Pausch et al., "CRISPR-Cas• from huge phages is a hypercompact genome editor," *Science,* 17 Jul. 2020, Vol. 369, Issue 6501, pp. 333-337, which is incorporated herein by reference in its entirety. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12j/Cas• protein. In some embodiments, the napDNAbp is a naturally-occurring Cas12j/Cas• protein. In some embodiments, the napDNAbp is a nuclease inactive ("dead") Cas12j/Cas• protein. It should be appreciated that Cas12j/Cas• from other species may also be used in accordance with the present disclosure.

Fusion Proteins with Internal Insertions

Provided herein are fusion proteins comprising a heterologous polypeptide fused to a nucleic acid programmable nucleic acid binding protein, for example, a napDNAbp. A heterologous polypeptide can be a polypeptide that is not found in the native or wild-type napDNAbp polypeptide sequence. The heterologous polypeptide can be fused to the napDNAbp at a C-terminal end of the napDNAbp, an N-terminal end of the napDNAbp, or inserted at an internal location of the napDNAbp In some embodiments, the heterologous polypeptide is a deaminase (e.g., cytidine of adenosine deaminase) or a functional fragment thereof. For example, a fusion protein can comprise a deaminase flanked by an N-terminal fragment and a C-terminal fragment of a Cas9 or Cas12 (e.g., Cas12b/C2c1), polypeptide. In some embodiments, the cytidine deaminase is an APOBEC deaminase (e.g., APOBEC1). In some embodiments, the adenosine deaminase is a TadA (e.g., TadA*7.10 or TadA*8). In some embodiments, the TadA is a TadA*8 or a TadA*9. TadA sequences (e.g., TadA7.10 or TadA*8) as described herein are suitable deaminases for the above-described fusion proteins.

In some embodiments, the fusion protein comprises the structure:

NH2-[N-terminal fragment of a napDNAbp]-[deaminase]-[C-terminal fragment of a napDNAbp]-COOH;

NH2-[N-terminal fragment of a Cas9]-[adenosine deaminase]-[C-terminal fragment of a Cas9]-COOH;

NH2-[N-terminal fragment of a Cas12]-[adenosine deaminase]-[C-terminal fragment of a Cas12]-COOH;

NH2-[N-terminal fragment of a Cas9]-[cytidine deaminase]-[C-terminal fragment of a Cas9]-COOH;

NH2-[N-terminal fragment of a Cas12]-[cytidine deaminase]-[C-terminal fragment of a Cas12]-COOH;

wherein each instance of "]-[" is an optional linker.

The deaminase can be a circular permutant deaminase. For example, the deaminase can be a circular permutant adenosine deaminase. In some embodiments, the deaminase is a circular permutant TadA, circularly permutated at amino acid residue 116, 136, or 65 as numbered in the TadA reference sequence.

The fusion protein can comprise more than one deaminase. The fusion protein can comprise, for example, 1, 2, 3, 4, 5 or more deaminases. In some embodiments, the fusion protein comprises one or two deaminase. The two or more deaminases in a fusion protein can be an adenosine deaminase, a cytidine deaminase, or a combination thereof. The two or more deaminases can be homodimers or heterodimers. The two or more deaminases can be inserted in tandem in the napDNAbp. In some embodiments, the two or more deaminases may not be in tandem in the napDNAbp.

In some embodiments, the napDNAbp in the fusion protein is a Cas9 polypeptide or a fragment thereof. The Cas9 polypeptide can be a variant Cas9 polypeptide. In some embodiments, the Cas9 polypeptide is a Cas9 nickase (nCas9) polypeptide or a fragment thereof. In some embodiments, the Cas9 polypeptide is a nuclease dead Cas9 (dCas9) polypeptide or a fragment thereof. The Cas9 polypeptide in a fusion protein can be a full-length Cas9 polypeptide. In some cases, the Cas9 polypeptide in a fusion protein may not be a full length Cas9 polypeptide. The Cas9 polypeptide can be truncated, for example, at a N-terminal or C-terminal end relative to a naturally-occurring Cas9 protein. The Cas9 polypeptide can be a circularly permuted Cas9 protein. The Cas9 polypeptide can be a fragment, a portion, or a domain of a Cas9 polypeptide, that is still capable of binding the target polynucleotide and a guide nucleic acid sequence.

In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or fragments or variants of any of the Cas9 polypeptides described herein.

In some embodiments, the fusion protein comprises an adenosine deaminase domain and a cytidine deaminase domain inserted within a Cas9. In some embodiments, an adenosine deaminase is fused within a Cas9 and a cytidine deaminase is fused to the C-terminus. In some embodiments, an adenosine deaminase is fused within Cas9 and a cytidine deaminase fused to the N-terminus. In some embodiments, a cytidine deaminase is fused within Cas9 and an adenosine deaminase is fused to the C-terminus. In some embodiments, a cytidine deaminase is fused within Cas9 and an adenosine deaminase fused to the N-terminus.

Exemplary structures of a fusion protein with an adenosine deaminase and a cytidine deaminase and a Cas9 are provided as follows:

NH2-[Cas9 (adenosine deaminase)]-[cytidine deaminase]-COOH;

NH2-[cytidine deaminase]-[Cas9 (adenosine deaminase)]-COOH;

NH2-[Cas9 (cytidine deaminase)]-[adenosine deaminase]-COOH; or

NH2-[adenosine deaminase]-[Cas9 (cytidine deaminase)]-COOH.

In some embodiments, the "-" used in the general architecture above indicates the presence of an optional linker.

In various embodiments, the catalytic domain has DNA modifying activity (e.g., deaminase activity), such as adenosine deaminase activity. In some embodiments, the adenosine deaminase is a TadA (e.g., TadA*7.10). In some embodiments, the TadA is a TadA*8. In some embodiments, a TadA*8 is fused within Cas9 and a cytidine deaminase is fused to the C-terminus. In some embodiments, a TadA*8 is fused within Cas9 and a cytidine deaminase fused to the N-terminus. In some embodiments, a cytidine deaminase is fused within Cas9 and a TadA*8 is fused to the C-terminus. In some embodiments, a cytidine deaminase is fused within Cas9 and a TadA*8 fused to the N-terminus. Exemplary structures of a fusion protein with a TadA*8 and a cytidine deaminase and a Cas9 are provided as follows:

NH2-[Cas9 (TadA*8)]-[cytidine deaminase]-COOH;

NH2-[cytidine deaminase]-[Cas9 (TadA*8)]-COOH;

NH2-[Cas9 (cytidine deaminase)]-[TadA*8]-COOH; or

NH2-[TadA*8]-[Cas9 (cytidine deaminase)]-COOH.

In some embodiments, the "-" used in the general architecture above indicates the presence of an optional linker.

The heterologous polypeptide (e.g., deaminase) can be inserted in the napDNAbp (e.g., Cas9 or Cas12 (e.g., Cas12b/C2c1)) at a suitable location, for example, such that the napDNAbp retains its ability to bind the target polynucleotide and a guide nucleic acid. A deaminase (e.g., adenosine deaminase, cytidine deaminase, or adenosine deaminase and cytidine deaminase) can be inserted into a napDNAbp without compromising function of the deaminase (e.g., base editing activity) or the napDNAbp (e.g., ability to bind to target nucleic acid and guide nucleic acid). A deaminase (e.g., adenosine deaminase, cytidine deaminase, or adenosine deaminase and cytidine deaminase) can be inserted in the napDNAbp at, for example, a disordered region or a region comprising a high temperature factor or B-factor as shown by crystallographic studies. Regions of a protein that are less ordered, disordered, or unstructured, for example solvent exposed regions and loops, can be used for insertion without compromising structure or function. A deaminase (e.g., adenosine deaminase, cytidine deaminase, or adenosine deaminase and cytidine deaminase) can be inserted in the napDNAbp in a flexible loop region or a solvent-exposed region. In some embodiments, the deaminase (e.g., adenosine deaminase, cytidine deaminase, or adenosine deaminase and cytidine deaminase) is inserted in a flexible loop of the Cas9 or the Cas12b/C2c1 polypeptide.

In some embodiments, the insertion location of a deaminase (e.g., adenosine deaminase, cytidine deaminase, or adenosine deaminase and cytidine deaminase) is determined by B-factor analysis of the crystal structure of Cas9 polypeptide. In some embodiments, the deaminase (e.g., adenosine deaminase, cytidine deaminase, or adenosine deaminase and cytidine deaminase) is inserted in regions of the Cas9 polypeptide comprising higher than average B-factors (e.g., higher B factors compared to the total protein or the protein domain comprising the disordered region). B-factor or temperature factor can indicate the fluctuation of atoms from their average position (for example, as a result of temperature-dependent atomic vibrations or static disorder in a crystal lattice) A high B-factor (e.g., higher than average B-factor) for backbone atoms can be indicative of a region with relatively high local mobility. Such a region can be used for inserting a deaminase without compromising structure or function. A deaminase (e.g., adenosine deaminase, cytidine deaminase, or adenosine deaminase and cytidine deaminase) can be inserted at a location with a residue having a C• atom with a B-factor that is 50%, 60%, 70%, 80%, 90%, 100%, 110%, 120%, 130%, 140%, 150%, 160%, 170%, 180%, 190%, 200%, or greater than 200% more than the average B-factor for the total protein. A deaminase (e.g., adenosine deaminase, cytidine deaminase, or adenosine deaminase and cytidine deaminase) can be inserted at a location with a residue having a C• atom with a B-factor that is 50%, 60%, 70%, 80%, 90%, 100%, 110%, 120%, 130%, 140%, 150%, 160%, 170%, 180%, 190%, 200% or greater than 200% more than the average B-factor for a Cas9 protein domain comprising the residue. Cas9 polypeptide positions comprising a higher than average B-factor can include, for example, residues 768, 792, 1052, 1015, 1022, 1026, 1029, 1067, 1040, 1054, 1068, 1246, 1247, and 1248 as numbered in the above Cas9 reference sequence. Cas9 polypeptide regions comprising a higher than average B-factor can include, for example, residues 792-872, 792-906, and 2-791 as numbered in the above Cas9 reference sequence.

A heterologous polypeptide (e.g., deaminase) can be inserted in the napDNAbp at an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. In some embodiments, the heterologous polypeptide is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the above Cas9 reference sequence or corresponding amino acid positions thereof. In some embodiments, the heterologous polypeptide is inserted between amino acid positions 769-770, 792-793, 793-794, 1016-1017, 1023-1024, 1027-1028, 1030-1031, 1041-1042, 1053-1054, 1055-1056, 1068-1069, 1069-1070, 1248-1249, or 1249-1250 as numbered in the above Cas9 reference sequence or corresponding amino acid positions thereof. In some embodiments, the heterologous polypeptide replaces an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. It should be understood that the reference to the above Cas9 reference sequence with respect to insertion positions is for illustrative purposes. The insertions as discussed herein are not limited to the Cas9 polypeptide sequence of the above Cas9 reference sequence, but include insertion at corresponding locations in variant Cas9 polypeptides, for example a Cas9 nickase (nCas9), nuclease dead Cas9 (dCas9), a Cas9 variant lacking a nuclease domain, a truncated Cas9, or a Cas9 domain lacking partial or complete HNH domain.

A heterologous polypeptide (e.g., deaminase) can be inserted in the napDNAbp at an amino acid residue selected from the group consisting of: 768, 792, 1022, 1026, 1040, 1068, and 1247 as numbered in the above Cas9 reference sequence, or a corresponding amino acid residue in another Cas9 polypeptide. In some embodiments, the heterologous polypeptide is inserted between amino acid positions 768-769, 792-793, 1022-1023, 1026-1027, 1029-1030, 1040-1041, 1068-1069, or 1247-1248 as numbered in the above Cas9 reference sequence or corresponding amino acid positions thereof. In some embodiments, the heterologous polypeptide is inserted between amino acid positions 769-770, 793-794, 1023-1024, 1027-1028, 1030-1031, 1041-1042, 1069-1070, or 1248-1249 as numbered in the above Cas9 reference sequence or corresponding amino acid positions thereof. In some embodiments, the heterologous polypeptide replaces an amino acid residue selected from the group consisting of: 768, 792, 1022, 1026, 1040, 1068, and 1247 as numbered in the above Cas9 reference sequence, or a corresponding amino acid residue in another Cas9 polypeptide.

A heterologous polypeptide (e.g., deaminase) can be inserted in the napDNAbp at an amino acid residue as described herein, or a corresponding amino acid residue in another Cas9 polypeptide. In an embodiment, a heterologous polypeptide (e.g., deaminase) can be inserted in the napDNAbp at an amino acid residue selected from the group consisting of: 1002, 1003, 1025, 1052-1056, 1242-1247, 1061-1077, 943-947, 686-691, 569-578, 530-539, and 1060-1077 as numbered in the above Cas9 reference sequence, or a corresponding amino acid residue in another Cas9 polypeptide. The deaminase (e.g., adenosine deaminase, cytidine deaminase, or adenosine deaminase and cytidine deaminase) can be inserted at the N-terminus or the C-terminus of the residue or replace the residue. In some embodiments, the deaminase (e.g., adenosine deaminase, cytidine deaminase, or adenosine deaminase and cytidine deaminase) is inserted at the C-terminus of the residue.

In some embodiments, an adenosine deaminase (e.g., TadA) is inserted at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, an adenosine deaminase (e.g., TadA) is inserted in place of residues 792-872, 792-906, or 2-791 as numbered in the above Cas9 reference sequence, or a corresponding amino acid residue in another Cas9 polypeptide. In some embodiments, the adenosine deaminase is inserted at the N-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted at the C-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted to replace an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

In some embodiments, a cytidine deaminase (e.g., APOBEC1) is inserted at an amino acid residue selected from the group consisting of: 1016, 1023, 1029, 1040, 1069, and 1247 as numbered in the above Cas9 reference sequence, or a corresponding amino acid residue in another Cas9 polypeptide. In some embodiments, the cytidine deaminase is inserted at the N-terminus of an amino acid selected from the group consisting of: 1016, 1023, 1029, 1040, 1069, and 1247 as numbered in the above Cas9 reference sequence, or a corresponding amino acid residue in another Cas9 polypeptide. In some embodiments, the cytidine deaminase is inserted at the C-terminus of an amino acid selected from the group consisting of: 1016, 1023, 1029, 1040, 1069, and 1247 as numbered in the above Cas9 reference sequence, or a corresponding amino acid residue in another Cas9 polypeptide. In some embodiments, the cytidine deaminase is inserted to replace an amino acid selected from the group consisting of: 1016, 1023, 1029, 1040, 1069, and 1247 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 768 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 791 or is inserted at amino acid residue 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid 791, or is inserted to replace amino acid 792, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1016 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1022, or is inserted at amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1022 or is inserted at the N-terminus of amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1022 or is inserted at the C-terminus of amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1022, or is inserted to replace amino acid residue 1023, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1026, or is inserted at amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1026 or is inserted at the N-terminus of amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1026 or is inserted at the C-terminus of amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1026, or is inserted to replace amino acid residue 1029, as numbered in the above Cas9 reference sequence, or corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1040 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1052, or is inserted at amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1052 or is inserted at the N-terminus of amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1052 or is inserted at the C-terminus of amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1052, or is inserted to replace amino acid residue 1054, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1067, or is inserted at amino acid residue 1068, or is inserted at amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1067 or is inserted at the N-terminus of amino acid residue 1068 or is inserted at the N-terminus of amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1067 or is inserted at the C-terminus of amino acid residue 1068 or is inserted at the C-terminus of amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1067, or is inserted to replace amino acid residue 1068, or is inserted to replace amino acid residue 1069, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1246, or is inserted at amino acid residue 1247, or is inserted at amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1246 or is inserted at the N-terminus of amino acid residue 1247 or is inserted at the N-terminus of amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1246 or is inserted at the C-terminus of amino acid residue 1247 or is inserted at the C-terminus of amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1246, or is inserted to replace amino acid residue 1247, or is inserted to replace amino acid residue 1248, as numbered in the above Cas9 reference sequence, or a corresponding amino acid residue in another Cas9 polypeptide.

In some embodiments, a heterologous polypeptide (e.g., deaminase) is inserted in a flexible loop of a Cas9 polypeptide. The flexible loop portions can be selected from the group consisting of 530-537, 569-570, 686-691, 943-947, 1002-1025, 1052-1077, 1232-1247, or 1298-1300 as numbered in the above Cas9 reference sequence, or a corresponding amino acid residue in another Cas9 polypeptide. The flexible loop portions can be selected from the group consisting of: 1-529, 538-568, 580-685, 692-942, 948-1001, 1026-1051, 1078-1231, or 1248-1297 as numbered in the above Cas9 reference sequence, or a corresponding amino acid residue in another Cas9 polypeptide.

A heterologous polypeptide (e.g., adenine deaminase) can be inserted into a Cas9 polypeptide region corresponding to amino acid residues: 1017-1069, 1242-1247, 1052-1056, 1060-1077, 1002-1003, 943-947, 530-537, 568-579, 686-691, 1242-1247, 1298-1300, 1066-1077, 1052-1056, or 1060-1077 as numbered in the above Cas9 reference sequence, or a corresponding amino acid residue in another Cas9 polypeptide.

A heterologous polypeptide (e.g., adenine deaminase) can be inserted in place of a deleted region of a Cas9 polypeptide. The deleted region can correspond to an N-terminal or C-terminal portion of the Cas9 polypeptide. In some embodiments, the deleted region corresponds to residues 792-872 as numbered in the above Cas9 reference sequence, or a corresponding amino acid residue in another Cas9 polypeptide. In some embodiments, the deleted region corresponds to residues 792-906 as numbered in the above Cas9 reference sequence, or a corresponding amino acid residue in another Cas9 polypeptide. In some embodiments, the deleted region corresponds to residues 2-791 as numbered in the above Cas9 reference sequence, or a corresponding amino acid residue in another Cas9 polypeptide. In some embodiments, the deleted region corresponds to residues 1017-1069 as numbered in the above Cas9 reference sequence, or corresponding amino acid residues thereof.

Exemplary internal fusions base editors are provided in Table 4 below:

TABLE 4

Insertion loci in Cas9 proteins

| BE ID | Modification | Other ID |
|---|---|---|
| IBE001 | Cas9 TadA ins 1015 | ISLAY01 |
| IBE002 | Cas9 TadA ins 1022 | ISLAY02 |
| IBE003 | Cas9 TadA ins 1029 | ISLAY03 |
| IBE004 | Cas9 TadA ins 1040 | ISLAY04 |
| IBE005 | Cas9 TadA ins 1068 | ISLAY05 |
| IBE006 | Cas9 TadA ins 1247 | ISLAY06 |
| IBE007 | Cas9 TadA ins 1054 | ISLAY07 |
| IBE008 | Cas9 TadA ins 1026 | ISLAY08 |
| IBE009 | Cas9 TadA ins 768 | ISLAY09 |
| IBE020 | delta HNH TadA 792 | ISLAY20 |
| IBE021 | N-term fusion single TadA helix truncated 165-end | ISLAY21 |
| IBE029 | TadA-Circular Permutant116 ins1067 | ISLAY29 |
| IBE031 | TadA- Circular Permutant 136 ins1248 | ISLAY31 |
| IBE032 | TadA- Circular Permutant 136ins 1052 | ISLAY32 |
| IBE035 | delta 792-872 TadA ins | ISLAY35 |
| IBE036 | delta 792-906 TadA ins | ISLAY36 |
| IBE043 | TadA-Circular Permutant 65 ins1246 | ISLAY43 |
| IBE044 | TadA ins C-term truncate2 791 | ISLAY44 |

A heterologous polypeptide (e.g., deaminase) can be inserted within a structural or functional domain of a Cas9 polypeptide. A heterologous polypeptide (e.g., deaminase) can be inserted between two structural or functional domains of a Cas9 polypeptide. A heterologous polypeptide (e.g., deaminase) can be inserted in place of a structural or functional domain of a Cas9 polypeptide, for example, after deleting the domain from the Cas9 polypeptide. The structural or functional domains of a Cas9 polypeptide can include, for example, RuvC I, RuvC II, RuvC III, Rec1, Rec2, PI, or HNH.

In some embodiments, the Cas9 polypeptide lacks one or more domains selected from the group consisting of. RuvC I, RuvC II, RuvC III, Rec1, Rec2, PI, or HNH domain. In some embodiments, the Cas9 polypeptide lacks a nuclease domain. In some embodiments, the Cas9 polypeptide lacks an HNH domain. In some embodiments, the Cas9 polypeptide lacks a portion of the HNH domain such that the Cas9 polypeptide has reduced or abolished HNH activity. In some embodiments, the Cas9 polypeptide comprises a deletion of the nuclease domain, and the deaminase is inserted to replace the nuclease domain. In some embodiments, the HNH domain is deleted and the deaminase is inserted in its place. In some embodiments, one or more of the RuvC domains is deleted and the deaminase is inserted in its place.

A fusion protein comprising a heterologous polypeptide can be flanked by a N-terminal and a C-terminal fragment of a napDNAbp. In some embodiments, the fusion protein comprises a deaminase flanked by a N-terminal fragment and a C-terminal fragment of a Cas9 polypeptide. The N terminal fragment or the C terminal fragment can bind the target polynucleotide sequence. The C-terminus of the N terminal fragment or the N-terminus of the C terminal fragment can comprise a part of a flexible loop of a Cas9 polypeptide. The C-terminus of the N terminal fragment or the N-terminus of the C terminal fragment can comprise a part of an alpha-helix structure of the Cas9 polypeptide. The N-terminal fragment or the C-terminal fragment can comprise a DNA binding domain. The N-terminal fragment or the C-terminal fragment can comprise a RuvC domain. The N-terminal fragment or the C-terminal fragment can comprise an HNH domain. In some embodiments, neither of the N-terminal fragment and the C-terminal fragment comprises an HNH domain.

In some embodiments, the C-terminus of the N terminal Cas9 fragment comprises an amino acid that is in proximity to a target nucleobase when the fusion protein deaminates the target nucleobase. In some embodiments, the N-terminus of the C terminal Cas9 fragment comprises an amino acid that is in proximity to a target nucleobase when the fusion protein deaminates the target nucleobase. The insertion location of different deaminases can be different in order to have proximity between the target nucleobase and an amino acid in the C-terminus of the N terminal Cas9 fragment or the N-terminus of the C terminal Cas9 fragment. For example, the insertion position of an deaminase can be at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

The N-terminal Cas9 fragment of a fusion protein (i.e. the N-terminal Cas9 fragment flanking the deaminase in a fusion protein) can comprise the N-terminus of a Cas9 polypeptide. The N-terminal Cas9 fragment of a fusion protein can comprise a length of at least about: 100, 200, 300, 400, 500, 600, 700, 800, 900, 1000, 1100, 1200, or 1300 amino acids. The N-terminal Cas9 fragment of a fusion protein can comprise a sequence corresponding to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide.

The C-terminal Cas9 fragment of a fusion protein (i.e. the C-terminal Cas9 fragment flanking the deaminase in a fusion protein) can comprise the C-terminus of a Cas9 polypeptide. The C-terminal Cas9 fragment of a fusion protein can comprise a length of at least about: 100, 200, 300, 400, 500, 600, 700, 800, 900, 1000, 1100, 1200, or 1300 amino acids. The C-terminal Cas9 fragment of a fusion protein can comprise a sequence corresponding to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide.

The N-terminal Cas9 fragment and C-terminal Cas9 fragment of a fusion protein taken together may not correspond to a full-length naturally occurring Cas9 polypeptide sequence, for example, as set forth in the above Cas9 reference sequence.

The fusion protein described herein can effect targeted deamination with reduced deamination at non-target sites (e.g., off-target sites), such as reduced genome wide spurious deamination. The fusion protein described herein can effect targeted deamination with reduced bystander deamination at non-target sites. The undesired deamination or off-target deamination can be reduced by at least 30%, at least 40%, at least 50%, at least 60%, at least 70%, at least 80%, at least 90%, at least 95%, or at least 99% compared with, for example, an end terminus fusion protein comprising the deaminase fused to a N terminus or a C terminus of a Cas9 polypeptide. The undesired deamination or off-target deamination can be reduced by at least one-fold, at least two-fold, at least three-fold, at least four-fold, at least five-fold, at least tenfold, at least fifteen fold, at least twenty fold, at least thirty fold, at least forty fold, at least fifty fold, at least 60 fold, at least 70 fold, at least 80 fold, at least 90 fold, or at least hundred fold, compared with, for example, an end terminus fusion protein comprising the deaminase fused to a N terminus or a C terminus of a Cas9 polypeptide.

In some embodiments, the deaminase (e.g., adenosine deaminase, cytidine deaminase, or adenosine deaminase and cytidine deaminase) of the fusion protein deaminates no more than two nucleobases within the range of an R-loop. In some embodiments, the deaminase of the fusion protein deaminates no more than three nucleobases within the range of the R-loop. In some embodiments, the deaminase of the fusion protein deaminates no more than 2, 3, 4, 5, 6, 7, 8, 9, or 10 nucleobases within the range of the R-loop. An R-loop is a three-stranded nucleic acid structure including a DNA: RNA hybrid, a DNA: DNA or an RNA: RNA complementary structure and the associated with single-stranded DNA. As used herein, an R-loop may be formed when a target polynucleotide is contacted with a CRISPR complex or a base editing complex, wherein a portion of a guide polynucleotide, e.g. a guide RNA, hybridizes with and displaces with a portion of a target polynucleotide, e.g. a target DNA. In some embodiments, an R-loop comprises a hybridized region of a spacer sequence and a target DNA complementary sequence. An R-loop region may be of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleobase pairs in length. In some embodiments, the R-loop region is about 20 nucleobase pairs in length. It should be understood that, as used herein, an R-loop region is not limited to the target DNA strand that hybridizes with the guide polynucleotide. For example, editing of a target nucleobase within an R-loop region may be to a DNA strand that comprises the complementary strand to a guide RNA, or may be to a DNA strand that is the opposing strand of the strand complementary to the guide RNA. In some embodiments, editing in the region of the R-loop comprises editing a nucleobase on non-complementary strand (protospacer strand) to a guide RNA in a target DNA sequence.

The fusion protein described herein can effect target deamination in an editing window different from canonical base editing. In some embodiments, a target nucleobase is from about 1 to about 20 bases upstream of a PAM sequence in the target polynucleotide sequence. In some embodiments, a target nucleobase is from about 2 to about 12 bases upstream of a PAM sequence in the target polynucleotide sequence. In some embodiments, a target nucleobase is from about 1 to 9 base pairs, about 2 to 10 base pairs, about 3 to 11 base pairs, about 4 to 12 base pairs, about 5 to 13 base pairs, about 6 to 14 base pairs, about 7 to 15 base pairs, about 8 to 16 base pairs, about 9 to 17 base pairs, about 10 to 18 base pairs, about 11 to 19 base pairs, about 12 to 20 base pairs, about 1 to 7 base pairs, about 2 to 8 base pairs, about 3 to 9 base pairs, about 4 to 10 base pairs, about 5 to 11 base pairs, about 6 to 12 base pairs, about 7 to 13 base pairs, about 8 to 14 base pairs, about 9 to 15 base pairs, about 10 to 16 base pairs, about 11 to 17 base pairs, about 12 to 18 base pairs, about 13 to 19 base pairs, about 14 to 20 base pairs, about 1 to 5 base pairs, about 2 to 6 base pairs, about 3 to 7 base pairs, about 4 to 8 base pairs, about 5 to 9 base pairs, about 6 to 10 base pairs, about 7 to 11 base pairs, about 8 to 12 base pairs, about 9 to 13 base pairs, about 10 to 14 base pairs, about 11 to 15 base pairs, about 12 to 16 base pairs, about 13 to 17 base pairs, about 14 to 18 base pairs, about 15 to 19 base pairs, about 16 to 20 base pairs, about 1 to 3 base pairs, about 2 to 4 base pairs, about 3 to 5 base pairs, about 4 to 6 base pairs, about 5 to 7 base pairs, about 6 to 8 base pairs, about 7 to 9 base pairs, about 8 to 10 base pairs, about 9 to 11 base pairs, about 10 to 12 base pairs, about 11 to 13 base pairs, about 12 to 14 base pairs, about 13 to 15 base pairs, about 14 to 16 base pairs, about 15 to 17 base pairs, about 16 to 18 base pairs, about 17 to 19 base pairs, about 18 to 20 base pairs away or upstream of the PAM sequence. In some embodiments, a target nucleobase is about 1, 2, 3, 4, 5, 6, 7, 8, 9, 10, 11, 12, 13, 14, 15, 16, 17, 18, 19, 20, or more base pairs away from or upstream of the PAM sequence. In some embodiments, a target nucleobase is about 1, 2, 3, 4, 5, 6, 7, 8, or 9 base pairs upstream of the PAM sequence. In some embodiments, a target nucleobase is about 2, 3, 4, or 6 base pairs upstream of the PAM sequence.

The fusion protein can comprise more than one heterologous polypeptide. For example, the fusion protein can additionally comprise one or more UGI domains and/or one or more nuclear localization signals. The two or more heterologous domains can be inserted in tandem. The two or more heterologous domains can be inserted at locations such that they are not in tandem in the NapDNAbp.

A fusion protein can comprise a linker between the deaminase and the napDNAbp polypeptide. The linker can be a peptide or a non-peptide linker. For example, the linker can be an XTEN, (GGGS)n (SEQ ID NO: 246), (GGGGS)n (SEQ ID NO: 247), (G)n, (EAAAK)n (SEQ ID NO: 248), (GGS)n, SGSETPGTSESATPES (SEQ ID NO: 249). In some embodiments, the fusion protein comprises a linker between the N-terminal Cas9 fragment and the deaminase. In some embodiments, the fusion protein comprises a linker between the C-terminal Cas9 fragment and the deaminase. In some embodiments, the N-terminal and C-terminal fragments of napDNAbp are connected to the deaminase with a linker. In some embodiments, the N-terminal and C-terminal fragments are joined to the deaminase domain without a linker. In some embodiments, the fusion protein comprises a linker between the N-terminal Cas9 fragment and the deaminase, but does not comprise a linker between the C-terminal Cas9 fragment and the deaminase. In some embodiments, the fusion protein comprises a linker between the C-terminal Cas9 fragment and the deaminase, but does not comprise a linker between the N-terminal Cas9 fragment and the deaminase.

In some embodiments, the napDNAbp in the fusion protein is a Cas12 polypeptide, e.g., Cas12b/C2c1, or a fragment thereof. The Cas12 polypeptide can be a variant Cas12 polypeptide. In other embodiments, the N- or C-terminal fragments of the Cas12 polypeptide comprise a nucleic acid programmable DNA binding domain or a RuvC domain. In other embodiments, the fusion protein contains a linker between the Cas12 polypeptide and the catalytic domain. In other embodiments, the amino acid sequence of the linker is GGSGGS (SEQ ID NO: 250) or GSSGSETPGTSESATPESSG (SEQ ID NO: 251). In other embodiments, the linker is a rigid linker. In other embodiments of the above aspects, the linker is encoded by GGAGGCTCTGGAGGAAGC (SEQ ID NO: 252) or GGCTCTTCTGGATCT-GAAACACCTGGCACAAGCGAGAGCGCCACCCCT-GAGAGCTC TGGC (SEQ ID NO: 253).

Fusion proteins comprising a heterologous catalytic domain flanked by N- and C-terminal fragments of a Cas12 polypeptide are also useful for base editing in the methods as described herein. Fusion proteins comprising Cas12 and one or more deaminase domains, e.g., adenosine deaminase, or comprising an adenosine deaminase domain flanked by Cas12 sequences are also useful for highly specific and efficient base editing of target sequences. In an embodiment, a chimeric Cas12 fusion protein contains a heterologous catalytic domain (e.g., adenosine deaminase, cytidine deaminase, or adenosine deaminase and cytidine deaminase) inserted within a Cas12 polypeptide. In some embodiments, the fusion protein comprises an adenosine deaminase domain and a cytidine deaminase domain inserted within a Cas12. In some embodiments, an adenosine deaminase is fused within Cas12 and a cytidine deaminase is fused to the C-terminus. In some embodiments, an adenosine deaminase is fused within Cas12 and a cytidine deaminase fused to the N-terminus. In some embodiments, a cytidine deaminase is fused within Cas12 and an adenosine deaminase is fused to the C-terminus. In some embodiments, a cytidine deaminase is fused within Cas12 and an adenosine deaminase fused to the N-terminus. Exemplary structures of a fusion protein with an adenosine deaminase and a cytidine deaminase and a Cas12 are provided as follows.

NH2-[Cas12 (adenosine deaminase)]-[cytidine deaminase]-COOH;

NH2-[cytidine deaminase]-[Cas12 (adenosine deaminase)]-COOH,

NH2-[Cas12 (cytidine deaminase)]-[adenosine deaminase]-COOH; or

NH2-[adenosine deaminase]-[Cas12 (cytidine deaminase)]-COOH;

In some embodiments, the "-" used in the general architecture above indicates the presence of an optional linker.

In various embodiments, the catalytic domain has DNA modifying activity (e.g., deaminase activity), such as adenosine deaminase activity. In some embodiments, the adenosine deaminase is a TadA (e.g., TadA*7.10). In some embodiments, the TadA is a TadA*8. In some embodiments, a TadA*8 is fused within Cas12 and a cytidine deaminase is fused to the C-terminus. In some embodiments, a TadA*8 is fused within Cas12 and a cytidine deaminase fused to the N-terminus. In some embodiments, a cytidine deaminase is fused within Cas12 and a TadA*8 is fused to the C-terminus. In some embodiments, a cytidine deaminase is fused within Cas12 and a TadA*8 fused to the N-terminus. Exemplary structures of a fusion protein with a TadA*8 and a cytidine deaminase and a Cas12 are provided as follows:

N-[Cas12 (TadA*8)]-[cytidine deaminase]-C;

N-[cytidine deaminase]-[Cas12 (TadA*8)]—C;

N-[Cas12 (cytidine deaminase)]-[TadA*8]—C; or

N-[TadA*8]-[Cas12 (cytidine deaminase)]-C.

In some embodiments, the "-" used in the general architecture above indicates the presence of an optional linker.

In other embodiments, the fusion protein contains one or more catalytic domains. In other embodiments, at least one of the one or more catalytic domains is inserted within the Cas12 polypeptide or is fused at the Cas12 N-terminus or C-terminus. In other embodiments, at least one of the one or more catalytic domains is inserted within a loop, an alpha helix region, an unstructured portion, or a solvent accessible portion of the Cas12 polypeptide. In other embodiments, the Cas12 polypeptide is Cas12a, Cas12b, Cas12c, Cas12d, Cas12e, Cas12g, Cas12h, Cas12i, or Cas12j/Cas•. In other embodiments, the Cas12 polypeptide has at least about 85% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b (SEQ ID NO: 254). In other embodiments, the Cas12 polypeptide has at least about 90% amino acid sequence identity to *Bacillus hisashii* Cas12b (SEQ ID NO: 255), *Bacillus thermoamylovorans* Cas12b, *Bacillus* sp. V3-13 Cas12b, or *Alicyclobacillus acidiphilus* Cas12b. In other embodiments, the Cas12 polypeptide has at least about 95% amino acid sequence identity to *Bacillus hisashii* Cas12b, *Bacillus thermoamylovorans* Cas12b (SEQ ID NO: 256), *Bacillus* sp. V3-13 Cas12b (SEQ ID NO: 257), or *Alicyclobacillus acidiphilus* Cas12b. In other embodiments, the Cas12 polypeptide contains or consists essentially of a fragment of *Bacillus hisashii* Cas12b, *Bacillus thermoamylovorans* Cas12b, *Bacillus* sp. V3-13 Cas12b, or *Alicyclobacillus acidiphilus* Cas12b. In embodiments, the Cas12 polypeptide contains BvCas12b (V4), which in some embodiments is expressed as 5' mRNA Cap---5' UTR---bhCas12b---STOP sequence---3' UTR---120poly A tail (SEQ ID NOs: 258-260).

In other embodiments, the catalytic domain is inserted between amino acid positions 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, Cas12i, or Cas12j/Cas•. In other embodiments, the catalytic domain is inserted between amino acids P153 and S154 of BhCas12b. In other embodiments, the catalytic domain is inserted between amino acids K255 and E256 of BhCas12b. In other embodiments, the catalytic domain is inserted between amino acids D980 and G981 of BhCas12b. In other embodiments, the catalytic domain is inserted between amino acids K1019 and L1020 of BhCas12b. In other embodiments, the catalytic domain is inserted between amino acids F534 and P535 of BhCas12b. In other embodiments, the catalytic domain is inserted between amino acids K604 and G605 of BhCas12b. In other embodiments, the catalytic domain is inserted between amino acids H344 and F345 of BhCas12b. In other embodiments, catalytic domain is inserted between amino acid positions 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, Cas12i, or Cas12j/Cas•. In other embodiments, the catalytic domain is inserted between amino acids P147 and D148 of BvCas12b. In other embodiments, the catalytic domain is inserted between amino acids G248 and G249 of BvCas12b. In other embodiments, the catalytic domain is inserted between amino acids P299 and E300 of BvCas12b. In other embodiments, the catalytic domain is inserted between amino acids G991 and E992 of BvCas12b. In other embodiments, the catalytic domain is inserted between amino acids K1031 and M1032 of BvCas12b. In other embodiments, the catalytic domain is inserted between amino acid positions 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, Cas12i, or Cas12j/Cas•. In other embodiments, the catalytic domain is inserted between amino acids P157 and G158 of AaCas12b. In other embodiments, the catalytic domain is inserted between amino acids V258 and G259 of AaCas12b. In other embodiments, the catalytic domain is inserted between amino acids D310 and P311 of AaCas12b. In other embodiments, the catalytic domain is inserted between amino acids G1008 and E1009 of AaCas12b. In other embodiments, the catalytic domain is inserted between amino acids G1044 and K1045 at of AaCas12b.

In other embodiments, the fusion protein contains a nuclear localization signal (e.g., a bipartite nuclear localization signal). In other embodiments, the amino acid sequence of the nuclear localization signal is MAPKKKRKVGIHGVPAA (SEQ ID NO: 261). In other embodiments of the above aspects, the nuclear localization signal is encoded by the following sequence:

ATGGCCCCAAAGAAGAAGCGGAAGGTCGGTATCCACGGAGTCCCAGCAGCC (SEQ ID NO: 262). In other embodiments, the Cas12b polypeptide contains a mutation that silences the catalytic activity of a RuvC domain. In other embodiments, the Cas12b polypeptide contains D574A, D829A and/or D952A mutations. In other embodiments, the fusion protein further contains a tag (e.g., an influenza hemagglutinin tag).

In some embodiments, the fusion protein comprises a napDNAbp domain (e.g., Cas12-derived domain) with an internally fused nucleobase editing domain (e.g., all or a portion of a deaminase domain, e.g., an adenosine deaminase domain). In some embodiments, the napDNAbp is a Cas12b. In some embodiments, the base editor comprises a BhCas12b domain with an internally fused TadA*8 domain inserted at the loci provided in Table 5 below.

TABLE 5

Insertion loci in Cas12b proteins

| | Insertion site | Inserted between aa |
|---|---|---|
| BhCas12b | | |
| position 1 | 153 | PS |
| position 2 | 255 | KE |
| position 3 | 306 | DE |
| position 4 | 980 | DG |
| position 5 | 1019 | KL |
| position 6 | 534 | FP |
| position 7 | 604 | KG |
| position 8 | 344 | HF |
| BvCas12b | | |
| position 1 | 147 | PD |
| position 2 | 248 | GG |
| position 3 | 299 | PE |
| position 4 | 991 | GE |
| position 5 | 1031 | KM |
| AaCas12b | | |
| position 1 | 157 | PG |
| position 2 | 258 | VG |
| position 3 | 310 | DP |
| position 4 | 1008 | GE |
| position 5 | 1044 | GK |

By way of nonlimiting example, an adenosine deaminase (e.g., TadA*8.13) may be inserted into a BhCas12b to produce a fusion protein (e.g., TadA*8.13-BhCas12b) that effectively edits a nucleic acid sequence.

In some embodiments, the base editing system described herein is an ABE with TadA inserted into a Cas9. Polypeptide sequences of relevant ABEs with TadA inserted into a Cas9 are provided in the attached Sequence Listing as SEQ ID NOs: 263-308.

In some embodiments, adenosine base editors were generated to insert TadA or variants thereof into the Cas9 polypeptide at the identified positions.

Exemplary, yet nonlimiting, fusion proteins are described in International PCT Application Nos. PCT/US2020/016285 and U.S. Provisional Application Nos. 62/852,228 and 62/852,224, the contents of which are incorporated by reference herein in their entireties.

A to G Editing

In some embodiments, a base editor described herein comprises an adenosine deaminase domain. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA). In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2) or tRNA (ADAT). A base editor comprising an adenosine deaminase domain can also be capable of deaminating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from *Escherichia coli* (EcTadA) comprising one or more of the following mutations: D108N, A106V, D147Y, E155V, L84F, H123Y, I156F, or a corresponding mutation in another adenosine deaminase. Exemplary ADAT homolog polypeptide sequences are provided in the Sequence Listing as SEQ ID NOs: 1 and 309-315.

The adenosine deaminase can be derived from any suitable organism (e.g., *E. coli*). In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*. In some embodiments, the adenine deaminase is a naturally-occurring adenosine deaminase that includes one or more mutations corresponding to any of the mutations provided herein (e.g., mutations in ecTadA) The corresponding residue in any homologous protein can be identified by e.g., sequence alignment and determination of homologous residues. The mutations in any naturally-occurring adenosine deaminase (e.g., having homology to ecTadA) that correspond to any of the mutations described herein (e.g., any of the mutations identified in ecTadA) can be generated accordingly.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identify plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

It should be appreciated that any of the mutations provided herein (e.g., based on the TadA reference sequence) can be introduced into other adenosine deaminases, such as *E. coli* TadA (ecTadA), *S. aureus* TadA (saTadA), or other adenosine deaminases (e.g., bacterial adenosine deaminases) It would be apparent to the skilled artisan that additional deaminases may similarly be aligned to identify homologous amino acid residues that can be mutated as provided herein. Thus, any of the mutations identified in the TadA reference sequence can be made in other adenosine deaminases (e.g., ecTada) that have homologous amino acid residues. It should also be appreciated that any of the mutations provided herein can be made individually or in any combination in the TadA reference sequence or another adenosine deaminase.

In some embodiments, the adenosine deaminase comprises a D108X mutation in the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase (e.g., ecTadA).

In some embodiments, the adenosine deaminase comprises a E155X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase (e.g., ecTadA).

In some embodiments, the adenosine deaminase comprises a D147X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase (e.g., ecTadA).

In some embodiments, the adenosine deaminase comprises an A106X, E155X, or D147X, mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

It should also be appreciated that any of the mutations provided herein may be made individually or in any combination in ecTadA or another adenosine deaminase. For example, an adenosine deaminase may contain a D108N, a A106V, a E155V, and/or a D147Y mutation in TadA reference sequence, or a corresponding mutation in another adenosine deaminase (e.g., ecTadA). In some embodiments, an adenosine deaminase comprises the following group of mutations (groups of mutations are separated by a ";") in TadA reference sequence, or corresponding mutations in another adenosine deaminase: D108N and A106V; D108N and E155V; D108N and D147Y, A106V and E155V; A106V and D147Y; E155V and D147Y; D108N, A106V, and E155V; D108N, A106V, and D147Y; D108N, E155V, and D147Y; A106V, E155V, and D147Y, and D108N, A106V, E155V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, 195X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, 195L, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in TadA reference sequence, or one or more corresponding mutations in another adenosine deaminase.

In some embodiments, the adenosine deaminase comprises one or more of a H8X, D108X, and/or N127X mutation in TadA reference sequence, or one or more corresponding mutations in another adenosine deaminase, where X indicates the presence of any amino acid. In some embodiments, the adenosine deaminase comprises one or more of a H8Y, D108N, and/or N127S mutation in TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, and D108X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R26X, L68X, D108X, N127X, D147X, and E155X, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of H8X, R126X, L68X, D108X, N127X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, D108X, A109X, N127X, and E155X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase (e.g., ecTadA). In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, R26W, L68Q, D108N, N127S, D147Y, and E155V in TadA reference sequence, or a corresponding mutation or mutations in another adenosine deaminase (e.g., ecTadA) In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase (e.g., ecTadA).

In some embodiments, the adenosine deaminase comprises one or more of the or one or more corresponding mutations in another adenosine deaminase. In some embodiments, the adenosine deaminase comprises a D108N, D108G, or D108V mutation in TadA reference sequence, or corresponding mutations in another adenosine deaminase. In some embodiments, the adenosine deaminase comprises a A106V and D108N mutation in TadA reference sequence, or corresponding mutations in another adenosine deaminase. In some embodiments, the adenosine deaminase comprises R107C and D108N mutations in TadA reference sequence, or corresponding mutations in another adenosine deaminase. In some embodiments, the adenosine deaminase comprises a H8Y, D108N, N127S, D147Y, and Q154H mutation in TadA reference sequence, or corresponding mutations in another adenosine deaminase. In some embodiments, the adenosine deaminase comprises a H8Y, D108N, N127S, D147Y, and E155V mutation in TadA reference sequence, or corresponding mutations in another adenosine deaminase. In some embodiments, the adenosine deaminase comprises a D108N, D147Y, and E155V mutation in TadA reference sequence, or corresponding mutations in another adenosine deaminase. In some embodiments, the adenosine deaminase comprises a H8Y, D108N, and N127S mutation in TadA reference sequence, or corresponding mutations in another adenosine deaminase. In some embodiments, the adenosine deaminase comprises a A106V, D108N, D147Y, and E155V mutation in TadA reference sequence, or corresponding mutations in another adenosine deaminase (e.g., ecTadA).

In some embodiments, the adenosine deaminase comprises one or more of S2X, H8X, I49X, L84X, H123X, N127X, I156X, and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, 149F, L84F, H123Y, N127S, I156F, and/or K160S mutation in TadA reference sequence, or one or more corresponding mutations in another adenosine deaminase (e.g., ecTadA).

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase (e.g., ecTadA).

In some embodiments, the adenosine deaminase comprises an H123X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase.

In some embodiments, the adenosine deaminase comprises an I156X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an I156F mutation in TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, 149X, A106X, D108X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five mutations selected from the group consisting of H8X, A106X, D108X, N127X, and K160X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase. In some embodiments, the adenosine deaminase comprises one, two, three, four, five, or six mutations selected from the group consisting of S2A, 149F, A106V, D108N, D147Y, and E155V in TadA reference sequence.

In some embodiments, the adenosine deaminase comprises one, two, three, four, or five mutations selected from the group consisting of H8Y, A106T, D108N, N127S, and K160S in TadA reference sequence, or a corresponding mutation or mutations in another adenosine deaminase.

In some embodiments, the adenosine deaminase comprises one or more of a E25X, R26X, R107X, A142X, and/or A143X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R107K, R107A, R107N, R107W, R107H, R107S, A142N, A142D, A142G, A143D, A143G, A143E, A143L, A143W, A143M, A143S, A143Q, and/or A143R mutation in TadA reference sequence, or one or more corresponding mutations in another adenosine deaminase. In some embodiments, the adenosine deaminase comprises one or more of the mutations described herein corresponding to TadA reference sequence, or one or more corresponding mutations in another adenosine deaminase.

In some embodiments, the adenosine deaminase comprises an E25X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase (e.g., ecTadA).

In some embodiments, the adenosine deaminase comprises an R26X mutation in TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase (e.g., ecTadA).

In some embodiments, the adenosine deaminase comprises an R107X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R107K, R107A, R107N, R107W, R107H, or R107S mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase (e.g., ecTadA).

In some embodiments, the adenosine deaminase comprises an A143X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q, and/or A143R mutation in TadA reference sequence, or a corresponding mutation in another adenosine deaminase (e.g., ecTadA).

In some embodiments, the adenosine deaminase comprises one or more of a H36X, N37X, P48X, 149X, R51X, M70X, N72X, D77X, E134X, S146X, Q154X, K157X, and/or K161X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, 149V, R51H, R51L, M70L, N72S, D77G, E134G, S146R, S146C, Q154H, K157N, and/or K161T mutation in TadA reference sequence, or one or more corresponding mutations in another adenosine deaminase (e.g., ecTadA).

In some embodiments, the adenosine deaminase comprises an H36X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase.

In some embodiments, the adenosine deaminase comprises an N37X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an N37T or N37S mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an P48T or P48L mutation in TadA reference sequence, or a corresponding mutation in another adenosine deaminase.

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H or R51L mutation in TadA reference sequence, or a corresponding mutation in another adenosine deaminase.

In some embodiments, the adenosine deaminase comprises an S146X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an S146R or S146C mutation in TadA reference sequence, or a corresponding mutation in another adenosine deaminase.

In some embodiments, the adenosine deaminase comprises an K157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase.

In some embodiments, the adenosine deaminase comprises an W23X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a W23R or W23L mutation in TadA reference sequence, or a corresponding mutation in another adenosine deaminase.

In some embodiments, the adenosine deaminase comprises an R152X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a R152P or R52H mutation in TadA reference sequence, or a corresponding mutation in another adenosine deaminase.

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses:

(A106V_D108N).
(R107C_D108N),
(H8Y_D108N_N127S_D147Y_Q154H),
(H8Y_D108N_N127S_D147Y_E155V),
(D108N_D147Y_EIS5V),
(H8Y_D108N_N127S),
(H8Y_D108N_N127S_D147Y_Q154H),
(A106V_D108N_D147Y_E155V),
(D108Q_D147Y_E155V),
(D108M_D147Y_E155V),
(D108L_D147Y_E155V),
(D108K_D147Y_E155V).
(D1081_D147Y_E155V),
(D108F_D147Y_E155V),
(A106V_D108N_D147Y),
(A106V_D108M_D147Y_E155V),
(E59A_A106V_D108N_D147Y_E155V),
(E59A cat dead_A106V_D108N_D147Y_E155V),
(L84F_A106V_D108N_H123Y_D147Y_E155V_I156Y),
(L84F_A106V_D108N_H123Y_D147Y_E155V_I156F),
(D103A_D104N),
(G22P_D103A_D104N),
(D103A_D104N_S138A),
(R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V_I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V_I156F).
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V_I156F),
(R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_D147Y_E155V_I156F_K157N),
(N37T_P48T_M70L_L84F_A106V_D108N_H123Y_D147Y_149V_E155V_I156F).
(N37S_L84F_A106V_D108N_H123Y_D147Y_E155V_156F_K161T).
(H36L_L84F_A106V_D108N_H123Y_D147Y_Q154H_E155V_I156F),
(N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_D147Y_E155V_I156F_K157N)
(H36L_L84F_A106V_D108N_H123Y_S146C_D147Y_E155V_I156F).
(L84F_A106V_D108N_H123Y_S146R_D147Y_E155V_I156F_K161T),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F1041_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F).
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T).
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T),
(L84F_A106V_D108N_H123Y_S146C_D147Y_E155V_I156F_K157N_K160E_K161T),
(L84F_A106V_D108N_H123Y_S146C_D147Y_E155V_I156F_K157N_K160E).
(R74Q_L84F_A106V_D108N_H123Y_D147Y_E155V_I156F),
(R74A L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F).
(L84F_R98Q_A106V_D108N_H123Y_D147Y_E155V_I156F).
(L84F_A106V_D108N_H123Y_R129Q_D147Y_E155V_I156F),
(P48S_L84F_A106V_D108N_H123Y_A142N_D147Y_E155V_I156F),
(P48S_A142N),
(P48T_I49V_L84F_A106V_D108N_H123Y_A142N_D147Y_E155V_I156F_L157N),
(P48T_149V_A142N), (H36L_P48S_R51L_L84F_A106V_D108N_H123Y_S146C_D147Y_E155V_I156F_K157N),
(H36L_P48S_R51L_L84F_A106V_D108N_H123Y_S146C_A142N_D147Y_E155V_I156F
(H36L_P48T_I49V_R51L_L84F_A106V_D108N_H123Y_S146C_D147Y_E155V_I156F_K157N),
(H36L_P48T_I49V_R51L_L84F_A106V_D108N_H123Y_A142N_S146C_D147Y_E155V_I156F_K157N),
(H36L_P48A_R51L_L84F_A106V_D108N_H123Y_S146C_D147Y_E155V_I156F_K157N),
(H36L_P48A_R51L_L84F_A106V_D108N_H123Y_A142N_S146C_D147Y_E155V_I156F_K157N),
(H36L_P48A_R51L_L84F_A106V_D108N_H123Y_S146C_A142N_D147Y_E155V_I156F_K157N),
(W23L_H36L_P48A_R51L_L84F_A106V_D108N_H123Y_S146C_D147Y_E155V_I156F_K157N),
(W23R_H36L_P48A_R51L_L84F_A106V_D108N_H123Y_S146C_D147Y_E155V_I156F_K157N),
(W23L_H36L_P48A_R51L_L84F_A106V_D108N_H123Y_S146R_D147Y_E155V_I156F_K161T),
(H36L_P48A_R51L_L84F_A106V_D108N_H123Y_S146C_D147Y_R152H_E155V_I156F_K157N),
(H36L_P48A_R51L_L84F_A106V_D108N_H123Y_S146C_D147Y_R152P_E155V_I156F_K157N),
(W23L_H36L_P48A_R51L_L84F_A106V_D108N_H123Y_S146C_D147Y_R152P_E155V_I156F_K157N),
(W23L_H36L_P48A_R51L_L84F_A106V_D108N_H123Y_A142A_S146C_D147Y_E155V_I156F_K157N),
(W23L_H36L_P48A_R51L_L84F_A106V_D108N_H123Y_A142A_S146C_D147Y_R152P_E155V_I156F_K157N).
(W23L_H36L_P48A_R51L_L84F_A106V_D108N_H123Y_S146R_D147Y_E155V_I156F_K161T),
(W23R_H36L_P48A_R51L_L84F_A106V_D108N_H123Y_S146C_D147Y_R152P_E155V_I156F K157N),
(H36L_P48A_R51L_L84F_A106V_D108N_H123Y_A142N_S146C_D147Y_R152P_E155V_I156F_K157N).

In some embodiments, the TadA deaminase is TadA variant. In some embodiments, the TadA variant is TadA*7.10. In particular embodiments, the fusion proteins comprise a single TadA*7.10 domain (e.g., provided as a monomer). In other embodiments, the fusion protein comprises TadA*7.10 and TadA (wt), which are capable of forming heterodimers. In one embodiment, a fusion protein of the invention comprises a wild-type TadA linked to TadA*7.10, which is linked to Cas9 nickase.

In some embodiments, TadA*7.10 comprises at least one alteration. In some embodiments, the adenosine deaminase comprises an alteration in the following sequence:

```
TadA*7.10
                                          (SEQ ID NO: 1)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD
```

In some embodiments, TadA*7.10 comprises an alteration at amino acid 82 and/or 166. In particular embodiments, TadA*7.10 comprises one or more of the following alterations: Y147T, Y147R, Q154S, Y123H, V82S, T166R, and/or Q154R. In other embodiments, a variant of TadA*7.10 comprises a combination of alterations selected from the group of: Y147T+Q154R; Y147T+Q154S; Y147R+Q154S; V82S+Q154S; V82S+Y147R; V82S+Q154R; V82S+Y123H; 176Y+V82S; V82S+Y123H+Y147T; V82S+Y123H+Y147R; V82S+Y123H+Q154R; Y147R+Q154R+Y123H; Y147R+Q154R+176Y; Y147R+Q154R+T166R; Y123H+Y147R+Q154R+176Y; V82S+Y123H+Y147R+Q154R; and 176Y+V82S+Y123H+Y147R+Q154R.

In some embodiments, an adenosine deaminase variant (e.g., TadA*8) comprises a deletion. In some embodiments, an adenosine deaminase variant comprises a deletion of the C terminus. In particular embodiments, an adenosine deaminase variant comprises a deletion of the C terminus beginning at residue 149, 150, 151, 152, 153, 154, 155, 156, and 157, relative to TadA*7.10, the TadA reference sequence, or a corresponding mutation in another TadA.

In other embodiments, an adenosine deaminase variant (e.g., TadA*8) is a monomer comprising one or more of the following alterations: Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant (TadA*8) is a monomer comprising a combination of alterations selected from the group of: Y147T+Q154R; Y147T+Q154S; Y147R+Q154S; V82S+Q154S; V82S+Y147R; V82S+Q154R; V82S+Y123H; 176Y+V82S; V82S+Y123H+Y147T; V82S+Y123H+Y147R; V82S+Y123H+Q154R; Y147R+Q154R+Y123H; Y147R+Q154R+176Y; Y147R+Q154R+T166R; Y123H+Y147R+Q154R+176Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a homodimer comprising two adenosine deaminase domains (e.g., TadA*8) each having one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a homodimer comprising two adenosine deaminase domains (e.g., TadA*8) each having a combination of alterations selected from the group of: Y147T+Q154R; Y147T+Q154S; Y147R+Q154S; V82S+Q154S; V82S+Y147R; V82S+Q154R; V82S+Y123H; 176Y+V82S; V82S+Y123H+Y147T; V82S+Y123H+Y147R; V82S+Y123H+Q154R; Y147R+Q154R+Y123H, Y147R+Q154R+176Y; Y147R+Q154R+T166R; Y123H+Y147R+Q154R+176Y; V82S+Y123H+Y147R+Q154R; and 176Y+V82S+Y123H+Y147R+Q154R, relative to TadA*7.10, the TadA reference sequence, or a corresponding mutation in another TadA.

In other embodiments, the adenosine deaminase variant is a heterodimer of a wild-type adenosine deaminase domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer of a wild-type adenosine deaminase domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+Y123H; 176Y+V82S; V82S+Y123H+Y147T; V82S+Y123H+

Y147R; V82S+Y123H+Q154R; Y147R+Q154R+Y123H; Y147R+Q154R+176Y; Y147R+Q154R+T166R; Y123H+Y147R+Q154R+176Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a heterodimer of a TadA*7.10 domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer of a TadA*7.10 domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+Y123H; 176Y+V82S; V82S+Y123H+Y147T; V82S+Y123H+Y147R; V82S+Y123H+Q154R, Y147R+Q154R+Y123H; Y147R+Q154R+176Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In particular embodiments, an adenosine deaminase heterodimer comprises a TadA*8 domain and an adenosine deaminase domain selected from *Staphylococcus aureus* (*S. aureus*) TadA, *Bacillus subtilis* (*B. subtilis*) TadA, *Salmonella typhimurium* (*S. typhimurium*) TadA, *Shewanella putrefaciens* (*S. putrefaciens*) TadA, *Haemophilus influenzae* F3031 (*H. influenzae*) TadA, *Caulobacter crescentus* (*C. crescentus*) TadA, *Geobacter sulfurreducens* (*G. sulfurreducens*) TadA, or TadA*7.10.

In some embodiments, an adenosine deaminase is a TadA*8. In one embodiment, an adenosine deaminase is a TadA*8 that comprises or consists essentially of the following sequence or a fragment thereof having adenosine deaminase activity:

```
                                      (SEQ ID NO: 316)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCT

FFRMPRQVFNAQKKAQSSTD
```

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In some embodiments the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

In other embodiments, a base editor of the disclosure comprising an adenosine deaminase variant (e.g., TadA*8) monomer comprising one or more of the following alterations: R26C, V88A, A109S, T111R, D119N, H122N, Y147D, F149Y, T166I and/or D167N, relative to TadA*7.10, the TadA reference sequence, or a corresponding mutation in another TadA. In other embodiments, the adenosine deaminase variant (TadA*8) monomer comprises a combination of alterations selected from the group of: R26C+A109S+T111R+D119N+H122N+Y147D+F149Y+T166I+D167N, V88A+A109S+T111R+D119N+H122N+F149Y+T166I+D167N; R26C+A109S+T111R+D119N+H122N+F149Y+T166I+D167N; V88A+T111R+D119N+F149Y; and A109S+T111R+D119N+H122N+Y147D+F149Y+T166I+D167N, relative to TadA*7.10, the TadA reference sequence, or a corresponding mutation in another TadA.

In other embodiments, a base editor comprises a heterodimer of a wild-type adenosine deaminase domain and an adenosine deaminase variant domain (e.g., TadA*8) comprising one or more of the following alterations R26C, V88A, A109S, T111R, D119N, H122N, Y147D, F149Y, T166I and/or D167N, relative to TadA*7.10, the TadA reference sequence, or a corresponding mutation in another TadA. In other embodiments, the base editor comprises a heterodimer of a wild-type adenosine deaminase domain and an adenosine deaminase variant domain (e.g., TadA*8) comprising a combination of alterations selected from the group of: R26C+A109S+T111R+D119N+H122N+Y147D+F149Y+T166I+D167N; V88A+A109S+T111R+D119N+H122N+F149Y+T166I+D167N; R26C+A109S+T111R+D119N+H122N+F149Y+T166I+D167N; V88A+T111R+D119N+F149Y; and A109S+T111R+D119N+H122N+Y147D+F149Y+T166I+D167N, relative to TadA*7.10, the TadA reference sequence, or a corresponding mutation in another TadA.

In other embodiments, a base editor comprises a heterodimer of a TadA*7.10 domain and an adenosine deaminase variant domain (e.g., TadA*8) comprising one or more of the following alterations R26C, V88A, A109S, T111R, D119N, H122N, Y147D, F149Y, T166I and/or D167N, relative to TadA*7.10, the TadA reference sequence, or a corresponding mutation in another TadA. In other embodiments, the base editor comprises a heterodimer of a TadA*7.10 domain and an adenosine deaminase variant domain (e.g., TadA*8) comprising a combination of alterations selected from the group of: R26C+A109S+T111R+D119N+H122N+Y147D+F149Y+T166I+D167N; V88A+A109S+T111R+D119N+H122N+F149Y+T166I+D167N, R26C+A109S+T111R+D119N+H122N+F149Y+T166I+D167N; V88A+T111R+D119N+F149Y; and A109S+T111R+D119N+H122N+Y147D+F149Y+T166I+D167N, relative to TadA*7.10, the TadA reference sequence, or a corresponding mutation in another TadA.

In some embodiments, the TadA*8 is a variant as shown in Table 6. Table 6 shows certain amino acid position numbers in the TadA amino acid sequence and the amino acids present in those positions in the TadA-7.10 adenosine deaminase. Table 6 also shows amino acid changes in TadA variants relative to TadA-7.10 following phage-assisted noncontinuous evolution (PANCE) and phage-assisted continuous evolution (PACE), as described in M. Richter et al., 2020, Nature Biotechnology, doi.org/10.1038/s41587-020-0453-z, the entire contents of which are incorporated by reference herein. In some embodiments, the TadA*8 is TadA*8a, TadA*8b, TadA*8c, TadA*8d, or TadA*8e. In some embodiments, the TadA*8 is TadA*8e.

TABLE 6

Select TadA*8 Variants

| | | TadA amino acid number | | | | | | | | | |
|---|---|---|---|---|---|---|---|---|---|---|---|
| | TadA | 26 | 88 | 109 | 111 | 119 | 122 | 147 | 149 | 166 | 167 |
| | TadA-7.10 | R | V | A | T | D | H | Y | F | T | D |
| PANCE 1 | | | | | R | | | | | | |
| PANCE 2 | | | | S/T | R | | | | | | |
| PACE | TadA-8a | C | | S | R | N | N | D | Y | I | N |
| | TadA-8b | | A | S | R | N | N | | Y | I | N |
| | TadA-8c | C | | S | R | N | N | | Y | I | N |
| | TadA-8d | | A | | R | N | | | Y | | |
| | TadA-8e | | | S | R | N | N | D | Y | I | N |

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the fusion protein comprises TadA*8 and TadA (wt), which are capable of forming heterodimers.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In particular embodiments, a TadA*8 comprises one or more mutations at any of the following positions shown in bold. In other embodiments, a TadA*8 comprises one or more mutations at any of the positions shown with underlining:

combination with any one or more of the following Y147T, Y147R, Q154S, Y123H, and/or Q154R, relative to TadA*7.10, the TadA reference sequence, or a corresponding mutation in another TadA. In particular embodiments, a combination of alterations is selected from the group of: Y147T+Q154R; Y147T+Q154S; Y147R+Q154S; V82S+Q154S; V82S+Y147R; V82S+Q154R; V82S+Y123H; 176Y+V82S; V82S+Y123H+Y147T; V82S+Y123H+Y147R; V82S+Y123H+Q154R; Y147R+Q154R+Y123H; Y147R+Q154R+176Y; Y147R+Q154R+T166R: Y123H+Y147R+Q154R+176Y; V82S+Y123H+Y147R+Q154R; and I76Y+V82S+Y123H+Y147R+Q154R, relative to TadA*7.10, the TadA reference sequence, or a corresponding mutation in another TadA.

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA (wt), which are capable of forming heterodimers.

In particular embodiments, the fusion proteins comprise a single (e.g., provided as a monomer) TadA*8. In some embodiments, the TadA*8 is linked to a Cas9 nickase. In some embodiments, the fusion proteins of the invention comprise as a heterodimer of a wild-type TadA (TadA (wt)) linked to a TadA*8. In other embodiments, the fusion proteins of the invention comprise as a heterodimer of a TadA*7.10 linked to a TadA*8. In some embodiments, the base editor is ABE8 comprising a TadA*8 variant monomer.

```
                                                 (SEQ ID NO: 1)
MSEVEFSHEY WMRHALTLAK RARDEREVPV GAVLVLNNRV IGEGWNRAIG    50

LHDPTAHAEI MALRQGGLVM QNYRLIDATL YVTFEPCVMC AGAMIHSRIG   100

RVVFGVRNAK TGAAGSLMDV LHYPGMNHRV EITEGILADE CAALLCYFFR   150

MPRQVFNAQK KAQSSTD
```

For example, the TadA*8 comprises alterations at amino acid position 82 and/or 166 (e.g., V82S, T166R) alone or in In some embodiments, the base editor is ABE8 comprising a heterodimer of a TadA*8 and a TadA (wt). In some embodiments, the base editor is ABE8 comprising a heterodimer of a TadA*8 and TadA*7.10. In some embodiments, the base editor is ABE8 comprising a heterodimer of a TadA*8. In some embodiments, the TadA*8 is selected from Table 6, 12, or 13. In some embodiments, the ABE8 is selected from Table 12, 13, or 15.

In some embodiments, the adenosine deaminase is a TadA*9 variant. In some embodiments, the adenosine deaminase is a TadA*9 variant selected from the variants described below and with reference to the following sequence (termed TadA*7.10):

(SEQ ID NO: 1)

MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCYFFR MPRQVFNAQK

KAQSSTD

In some embodiments, an adenosine deaminase comprises one or more of the following alterations: R21N, R23H, E25F, N38G, L51W, P54C, M70V, Q71M, N72K, Y73S, V82T, M94V, P124W, T133K, D139L, D139M, C146R, and A158K. The one or more alternations are shown in the sequence above in underlining and bold font.

In some embodiments, an adenosine deaminase comprises one or more of the following combinations of alterations: V82S+Q154R+Y147R; V82S+Q154R+Y123H; V82S+Q154R+Y147R+Y123H; Q154R+Y147R+Y123H+176Y+V82S; V82S+176Y; V82S+Y147R; V82S+Y147R+Y123H, V82S+Q154R+Y123H; Q154R+Y147R+Y123H+176Y; V82S+Y147R; V82S+Y147R+Y123H; V82S+Q154R+Y123H; V82S+Q154R+Y147R; V82S+Q154R+Y147R; Q154R+Y147R+Y123H+176Y; Q154R+Y147R+Y123H+176Y+V82S; 176Y V82S_Y123H_Y147R_Q154R; Y147R+Q154R+H123H; and V82S+Q154R.

In some embodiments, an adenosine deaminase comprises one or more of the following combinations of alterations: E25F+V82S+Y123H, T133K+Y147R+Q154R: E25F+V82S+Y123H+Y147R+Q154R; L51W+V82S+Y123H+C146R+Y147R+Q154R; Y73S+V82S+Y123H+Y147R+Q154R: P54C+V82S+Y123H+Y147R+Q154R; N38G+V82T+Y123H+Y147R+Q154R; N72K+V82S+Y123H+D139L+Y147R+Q154R; E25F+V82S+Y123H+D139M+Y147R+Q154R; Q71M+V82S+Y123H+Y147R+Q154R; E25F+V82S+Y123H+T133K+Y147R+Q154R; E25F+V82S+Y123H+Y147R+Q154R; V82S+Y123H+P124W+Y147R+Q154R; L51W+V82S+Y123H+C146R+Y147R+Q154R; P54C+V82S+Y123H+Y147R+Q154R; Y73S+V82S+Y123H+Y147R+Q154R; N38G+V82T+Y123H+Y147R+Q154R; R23H+V82S+Y123H+Y147R+Q154R; R21N+V82S+Y123H+Y147R+Q154R; V82S+Y123H+Y147R+Q154R+A158K; N72K+V82S+Y123H+D139L+Y147R+Q154R; E25F+V82S+Y123H+D139M+Y147R+Q154R; and M70V+V82S+M94V+Y123H+Y147R+Q154R.

In some embodiments, an adenosine deaminase comprises one or more of the following combinations of alterations: Q71M+V82S+Y123H+Y147R+Q154R; E25F+176Y+V82S+Y123H+Y147R+Q154R; 176Y+V82T+Y123H+Y147R+Q154R; N38G+176Y+V82S+Y123H+Y147R+Q154R; R23H+176Y+V82S+Y123H+Y147R+Q154R; P54C+176Y+V82S+Y123H+Y147R+Q154R; R21N+176Y+V82S+Y123H+Y147R+Q154R; I76Y+V82S+Y123H+D139M+Y147R+Q154R; Y73S+176Y+V82S+Y123H+Y147R+Q154R; E25F+176Y+V82S+Y123H+Y147R+Q154R; 176Y+V82T+Y123H+Y147R+Q154R; N38G+176Y+V82S+Y123H+Y147R+Q154R; R23H+176Y+V82S+Y123H+Y147R+Q154R; P54C+176Y+V82S+Y123H+Y147R+Q154R; R21N+176Y+V82S+Y123H+Y147R+Q154R; I76Y+V82S+Y123H+D139M+Y147R+Q154R; Y73S+176Y+V82S+Y123H+Y147R+Q154R; and V82S+Q154R; N72K_V82S+Y123H+Y147R+Q154R; Q71M_V82S+Y123H+Y147R+Q154R; V82S+Y123H+T133K+Y147R+Q154R; V82S+Y123H+T133K+Y147R+Q154R+A158K; M70V+Q71M+N72K+V82S+Y123H+Y147R+Q154R: N72K_V82S+Y123H+Y147R+Q154R; Q71M_V82S+Y123H+Y147R+Q154R; M70V+V82S+M94V+Y123H+Y147R+Q154R; V82S+Y123H+T133K+Y147R+Q154R; V82S+Y123H+T133K+Y147R+Q154R+A158K; and M70V+Q71M+N72K+V82S+Y123H+Y147R+Q154R. In some embodiments, the adenosine deaminase is expressed as a monomer. In other embodiments, the adenosine deaminase is expressed as a heterodimer. In some embodiments, the deaminase or other polypeptide sequence lacks a methionine, for example when included as a component of a fusion protein. This can alter the numbering of positions. However, the skilled person will understand that such corresponding mutations refer to the same mutation, e.g., Y73S and Y72S and D139M and D138M.

In some embodiments, the TadA*9 variant comprises the alterations described in Table 16 as described herein. In some embodiments, the TadA*9 variant is a monomer. In some embodiments, the TadA*9 variant is a heterodimer with a wild-type TadA adenosine deaminase. In some embodiments, the TadA*9 variant is a heterodimer with another TadA variant (e.g., TadA*8, TadA*9). Additional details of TadA*9 adenosine deaminases are described in International PCT Application No. PCT/2020/049975, which is incorporated herein by reference for its entirety.

Any of the mutations provided herein and any additional mutations (e.g., based on the ecTadA amino acid sequence) can be introduced into any other adenosine deaminases. Any of the mutations provided herein can be made individually or in any combination in TadA reference sequence or another adenosine deaminase (e.g., ecTadA).

Details of A to G nucleobase editing proteins are described in International PCT Application No. PCT/2017/045381 (WO2018/027078) and Gaudelli, N. M., et al., "Programmable base editing of A•T to G•C in genomic DNA without DNA cleavage" Nature, 551, 464-471 (2017), the entire contents of which are hereby incorporated by reference.

C to T Editing

In some embodiments, a base editor disclosed herein comprises a fusion protein comprising cytidine deaminase capable of deaminating a target cytidine (C) base of a polynucleotide to produce uridine (U), which has the base pairing properties of thymine. In some embodiments, for example where the polynucleotide is double-stranded (e.g., DNA), the uridine base can then be substituted with a thymidine base (e.g., by cellular repair machinery) to give rise to a C:G to a T:A transition. In other embodiments, deamination of a C to U in a nucleic acid by a base editor cannot be accompanied by substitution of the U to a T.

The deamination of a target C in a polynucleotide to give rise to a U is a non-limiting example of a type of base editing that can be executed by a base editor described herein. In another example, a base editor comprising a cytidine deaminase domain can mediate conversion of a cytosine (C) base to a guanine (G) base. For example, a U of a polynucleotide produced by deamination of a cytidine by a cytidine deaminase domain of a base editor can be excised from the polynucleotide by a base excision repair mechanism (e.g., by a uracil DNA glycosylase (UDG) domain), producing an abasic site. The nucleobase opposite the abasic site can then be substituted (e.g., by base repair machinery) with another base, such as a C, by for example a translesion polymerase Although it is typical for a nucleobase opposite an abasic site to be replaced with a C, other substitutions (e.g., A, G or T) can also occur.

Accordingly, in some embodiments a base editor described herein comprises a deamination domain (e.g., cytidine deaminase domain) capable of deaminating a target C to a U in a polynucleotide. Further, as described below, the base editor can comprise additional domains which facilitate conversion of the U resulting from deamination to, in some embodiments, a T or a G. For example, a base editor comprising a cytidine deaminase domain can further comprise a uracil glycosylase inhibitor (UGI) domain to mediate substitution of a U by a T, completing a C-to-T base editing event. In another example, a base editor can incorporate a translesion polymerase to improve the efficiency of C-to-G base editing, since a translesion polymerase can facilitate incorporation of a C opposite an abasic site (i.e., resulting in incorporation of a G at the abasic site, completing the C-to-G base editing event).

A base editor comprising a cytidine deaminase as a domain can deaminate a target C in any polynucleotide, including DNA, RNA and DNA-RNA hybrids. Typically, a cytidine deaminase catalyzes a C nucleobase that is positioned in the context of a single-stranded portion of a polynucleotide. In some embodiments, the entire polynucleotide comprising a target C can be single-stranded. For example, a cytidine deaminase incorporated into the base editor can deaminate a target C in a single-stranded RNA polynucleotide. In other embodiments, a base editor comprising a cytidine deaminase domain can act on a double-stranded polynucleotide, but the target C can be positioned in a portion of the polynucleotide which at the time of the deamination reaction is in a single-stranded state. For example, in embodiments where the NAGPB domain comprises a Cas9 domain, several nucleotides can be left unpaired during formation of the Cas9-gRNA-target DNA complex, resulting in formation of a Cas9 "R-loop complex". These unpaired nucleotides can form a bubble of single-stranded DNA that can serve as a substrate for a single-strand specific nucleotide deaminase enzyme (e.g., cytidine deaminase).

In some embodiments, a cytidine deaminase of a base editor can comprise all or a portion of an apolipoprotein B mRNA editing complex (APOBEC) family deaminase. APOBEC is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. In some embodiments, a deaminase incorporated into a base editor comprises all or a portion of an APOBEC1 deaminase. In some embodiments, a deaminase incorporated into a base editor comprises all or a portion of APOBEC2 deaminase. In some embodiments, a deaminase incorporated into a base editor comprises all or a portion of is an APOBEC3 deaminase. In some embodiments, a deaminase incorporated into a base editor comprises all or a portion of an APOBEC3A deaminase. In some embodiments, a deaminase incorporated into a base editor comprises all or a portion of APOBEC3B deaminase. In some embodiments, a deaminase incorporated into a base editor comprises all or a portion of APOBEC3C deaminase. In some embodiments, a deaminase incorporated into a base editor comprises all or a portion of APOBEC3D deaminase. In some embodiments, a deaminase incorporated into a base editor comprises all or a portion of APOBEC3E deaminase. In some embodiments, a deaminase incorporated into a base editor comprises all or a portion of APOBEC3F deaminase. In some embodiments, a deaminase incorporated into a base editor comprises all or a portion of APOBEC3G deaminase. In some embodiments, a deaminase incorporated into a base editor comprises all or a portion of APOBEC3H deaminase. In some embodiments, a deaminase incorporated into a base editor comprises all or a portion of APOBEC4 deaminase. In some embodiments, a deaminase incorporated into a base editor comprises all or a portion of activation-induced deaminase (AID). In some embodiments a deaminase incorporated into a base editor comprises all or a portion of cytidine deaminase 1 (CDA1). It should be appreciated that a base editor can comprise a deaminase from any suitable organism (e.g., a human or a rat). In some embodiments, a deaminase domain of a base editor is from a human, chimpanzee, gorilla, monkey, cow, dog, rat, or mouse. In some embodiments, the deaminase domain of the base editor is derived from rat (e.g., rat APOBEC1). In some embodiments, the deaminase domain of the base editor is human APOBEC1. In some embodiments, the deaminase domain of the base editor is pmCDA1.

Other exemplary deaminases that can be fused to Cas9 according to aspects of this disclosure are provided below. In embodiments, the deaminases are activation-induced deaminases (AID). It should be understood that, in some embodiments, the active domain of the respective sequence can be used, e.g., the domain without a localizing signal (nuclear localization sequence, without nuclear export signal, cytoplasmic localizing signal).

Some aspects of the present disclosure are based on the recognition that modulating the deaminase domain catalytic activity of any of the fusion proteins described herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window can prevent unwanted deamination of residues adjacent to specific target residues, which can decrease or prevent off-target effects.

For example, in some embodiments, an APOBEC deaminase incorporated into a base editor can comprise one or more mutations selected from the group consisting of H121X, H122X, R126X, R126X, R118X, W90X, W90X, and R132X of rAPOBEC1, or one or more corresponding mutations in another APOBEC deaminase, wherein X is any amino acid. In some embodiments, an APOBEC deaminase incorporated into a base editor can comprise one or more mutations selected from the group consisting of H121R, H122R, R126A, R126E, R118A, W90A, W90Y, and R132E of rAPOBEC1, or one or more corresponding mutations in another APOBEC deaminase.

In some embodiments, an APOBEC deaminase incorporated into a base editor can comprise one or more mutations selected from the group consisting of D316X, D317X, R320X, R320X, R313X, W285X, W285X, R326X of hAPOBEC3G, or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G, or one or more corresponding mutations in another APOBEC deaminase.

In some embodiments, an APOBEC deaminase incorporated into a base editor can comprise a H121R and a H122R mutation of rAPOBEC1, or one or more corresponding mutations in another APOBEC deaminase. In some embodiments an APOBEC deaminase incorporated into a base editor can comprise an APOBEC deaminase comprising a R126A mutation of rAPOBEC1, or one or more corresponding mutations in another APOBEC deaminase. In some embodiments, an APOBEC deaminase incorporated into a base editor can comprise an APOBEC deaminase comprising a R126E mutation of rAPOBEC1, or one or more corresponding mutations in another APOBEC deaminase. In some embodiments, an APOBEC deaminase incorporated into a base editor can comprise an APOBEC deaminase comprising a R118A mutation of rAPOBEC1, or one or more corresponding mutations in another APOBEC deaminase. In some embodiments, an APOBEC deaminase incorporated into a base editor can comprise an APOBEC deaminase comprising a W90A mutation of rAPOBEC1, or one or more corresponding mutations in another APOBEC deaminase. In some embodiments, an APOBEC deaminase incorporated into a base editor can comprise an APOBEC deaminase comprising a W90Y mutation of rAPOBEC1, or one or more corresponding mutations in another APOBEC deaminase. In some embodiments, an APOBEC deaminase incorporated into a base editor can comprise an APOBEC deaminase comprising a R132E mutation of rAPOBEC1, or one or more corresponding mutations in another APOBEC deaminase. In some embodiments an APOBEC deaminase incorporated into a base editor can comprise an APOBEC deaminase comprising a W90Y and a R126E mutation of rAPOBEC1, or one or more corresponding mutations in another APOBEC deaminase. In some embodiments, an APOBEC deaminase incorporated into a base editor can comprise an APOBEC deaminase comprising a R126E and a R132E mutation of rAPOBEC1, or one or more corresponding mutations in another APOBEC deaminase. In some embodiments, an APOBEC deaminase incorporated into a base editor can comprise an APOBEC deaminase comprising a W90Y and a R132E mutation of rAPOBEC1, or one or more corresponding mutations in another APOBEC deaminase. In some embodiments, an APOBEC deaminase incorporated into a base editor can comprise an APOBEC deaminase comprising a W90Y, R126E, and R132E mutation of rAPOBEC1, or one or more corresponding mutations in another APOBEC deaminase.

In some embodiments, an APOBEC deaminase incorporated into a base editor can comprise an APOBEC deaminase comprising a D316R and a D317R mutation of hAPOBEC3G, or one or more corresponding mutations in another APOBEC deaminase. In some embodiments, any of the fusion proteins provided herein comprise an APOBEC deaminase comprising a R320A mutation of hAPOBEC3G, or one or more corresponding mutations in another APOBEC deaminase. In some embodiments, an APOBEC deaminase incorporated into a base editor can comprise an APOBEC deaminase comprising a R320E mutation of hAPOBEC3G, or one or more corresponding mutations in another APOBEC deaminase. In some embodiments, an APOBEC deaminase incorporated into a base editor can comprise an APOBEC deaminase comprising a R313A mutation of hAPOBEC3G, or one or more corresponding mutations in another APOBEC deaminase. In some embodiments, an APOBEC deaminase incorporated into a base editor can comprise an APOBEC deaminase comprising a W285A mutation of hAPOBEC3G, or one or more corresponding mutations in another APOBEC deaminase. In some embodiments, an APOBEC deaminase incorporated into a base editor can comprise an APOBEC deaminase comprising a W285Y mutation of hAPOBEC3G, or one or more corresponding mutations in another APOBEC deaminase. In some embodiments, an APOBEC deaminase incorporated into a base editor can comprise an APOBEC deaminase comprising a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R320E mutation of hAPOBEC3G, or one or more corresponding mutations in another APOBEC deaminase. In some embodiments, an APOBEC deaminase incorporated into a base editor can comprise an APOBEC deaminase comprising a R320E and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y, R320E, and R326E mutation of hAPOBEC3G, or one or more corresponding mutations in another APOBEC deaminase.

A number of modified cytidine deaminases are commercially available, including, but not limited to, SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177). In some embodiments, a deaminase incorporated into a base editor comprises all or a portion of an APOBEC1 deaminase.

In some embodiments, the fusion proteins of the invention comprise one or more cytidine deaminase domains. In some embodiments, the cytidine deaminases provided herein are capable of deaminating cytosine or 5-methylcytosine to uracil or thymine. In some embodiments, the cytidine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). Some embodiments provide a polynucleotide molecule encoding the cytidine deaminase nucleobase editor polypeptide of any previous aspect or as delineated herein. In some embodiments, the polynucleotide is codon optimized.

The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

A fusion protein of the invention second protein comprises two or more nucleic acid editing domains.

Details of C to T nucleobase editing proteins are described in International PCT Application No. PCT/US2016/058344 (WO2017/070632) and Komor, A. C., et al., "Programmable editing of a target base in genomic DNA without double-stranded DNA cleavage" Nature 533, 420-424 (2016), the entire contents of which are hereby incorporated by reference.

Guide Polynucleotides

A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3•-5• exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M., et al. Science 337:816-821 (2012), the entire contents of which is hereby incorporated by reference. Cas9 recognizes a short motif in the CRISPR repeat sequences (the PAM or protospacer adjacent motif) to help distinguish self versus non-self. See e.g., "Complete genome sequence of an MI strain of *Streptococcus pyogenes*." Ferretti, J. J. et al., Natl. Acad. Sci. U.S.A. 98:4658-4663 (2001); "CRISPR RNA maturation by trans-encoded small RNA and host factor RNase III." Deltcheva E. et al., Nature 471:602-607 (2011); and "Programmable dual-RNA-guided DNA endonuclease in adaptive bacterial immunity." Jinek M. et al, Science 337:816-821 (2012), the entire contents of each of which are incorporated herein by reference).

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR (N), TTTV, TYCV, TYCV, TATV, NNNNGATT, NNAGAAW, or NAAAAC. Y is a pyrimidine; N is any nucleotide base; W is A or T.

In an embodiment, a guide polynucleotide described herein can be RNA or DNA. In one embodiment, the guide polynucleotide is a gRNA. An RNA/Cas complex can assist in "guiding" a Cas protein to a target DNA. Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M. et al., Science 337:816-821 (2012), the entire contents of which is hereby incorporated by reference.

In some embodiments, the guide polynucleotide is at least one single guide RNA ("sgRNA" or "gRNA"). In some embodiments, a guide polynucleotide comprises two or more individual polynucleotides, which can interact with one another via for example complementary base pairing (e.g., a dual guide polynucleotide, dual gRNA). For example, a guide polynucleotide can comprise a CRISPR RNA (crRNA) and a trans-activating CRISPR RNA (tracrRNA) or can comprise one or more trans-activating CRISPR RNA (tracrRNA).

In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

A guide polynucleotide may include natural or non-natural (or unnatural) nucleotides (e.g., peptide nucleic acid or nucleotide analogs). In some cases, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In some embodiments, the methods described herein can utilize an engineered Cas protein. A guide RNA (gRNA) is a short synthetic RNA composed of a scaffold sequence necessary for Cas-binding and a user-defined. 20 nucleotide spacer that defines the genomic target to be modified. Exemplary gRNA scaffold sequences are provided in the sequence listing as SEQ ID NOs: 317-327. Thus, a skilled artisan can change the genomic target of the Cas protein specificity is partially determined by how specific the gRNA targeting sequence is for the genomic target compared to the rest of the genome.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other cases, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

The guide polynucleotides can be synthesized chemically, synthesized enzymatically, or a combination thereof. For example, the gRNA can be synthesized using standard phosphoramidite-based solid-phase synthesis methods. Alternatively, the gRNA can be synthesized in vitro by operably linking DNA encoding the gRNA to a promoter control sequence that is recognized by a phage RNA polymerase. Examples of suitable phage promoter sequences include T7, T3, SP6 promoter sequences, or variations thereof. In embodiments in which the gRNA comprises two separate molecules (e.g., crRNA and tracrRNA), the crRNA can be chemically synthesized and the tracrRNA can be enzymatically synthesized.

A guide polynucleotide may be expressed, for example, by a DNA that encodes the gRNA, e.g., a DNA vector comprising a sequence encoding the gRNA. The gRNA may be encoded alone or together with an encoded base editor. Such DNA sequences may be introduced into an expression system, e.g., a cell, together or separately. For example, DNA sequences encoding a polynucleotide programmable nucleotide binding domain and a gRNA may be introduced into a cell, each DNA sequence can be part of a separate molecule (e.g., one vector containing the polynucleotide programmable nucleotide binding domain coding sequence and a second vector containing the gRNA coding sequence) or both can be part of a same molecule (e.g., one vector containing coding (and regulatory) sequence for both the polynucleotide programmable nucleotide binding domain and the gRNA). An RNA can be transcribed from a synthetic DNA molecule, e.g., a gBlocks® gene fragment. A gRNA molecule can be transcribed in vitro.

A gRNA or a guide polynucleotide can comprise three regions: a first region at the 5' end that can be complementary to a target site in a chromosomal sequence, a second internal region that can form a stem loop structure, and a third 3' region that can be single-stranded. A first region of each gRNA can also be different such that each gRNA guides a fusion protein to a specific target site. Further, second and third regions of each gRNA can be identical in all gRNAs.

A first region of a gRNA or a guide polynucleotide can be complementary to sequence at a target site in a chromosomal sequence such that the first region of the gRNA can base pair with the target site. In some cases, a first region of a gRNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides; or from about 10 nucleotides to 25 nucleotides) or more. For example, a region of base pairing between a first region of a gRNA and a target site in a chromosomal sequence can be or can be about 10, 11, 12, 13, 14, 15, 16, 17, 18, 19, 20, 22, 23, 24, 25, or more nucleotides in length. Sometimes, a first region of a gRNA can be or can be about 19, 20, or 21 nucleotides in length.

A gRNA or a guide polynucleotide can also comprise a second region that forms a secondary structure. For example, a secondary structure formed by a gRNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A gRNA or a guide polynucleotide can also comprise a third region at the 3' end that can be essentially single-stranded. For example, a third region is sometimes not complementarity to any chromosomal sequence in a cell of interest and is sometimes not complementarity to the rest of a gRNA. Further, the length of a third region can vary. A third region can be more than or more than about 4 nucleotides in length. For example, the length of a third region can range from or from about 5 to 60 nucleotides in length.

A gRNA or a guide polynucleotide can target any exon or intron of a gene target. In some cases, a guide can target exon 1 or 2 of a gene, in other cases; a guide can target exon 3 or 4 of a gene. In some embodiments, a composition comprises multiple gRNAs that all target the same exon or multiple gRNAs that target different exons. An exon and/or an intron of a gene can be targeted.

A gRNA or a guide polynucleotide can target a nucleic acid sequence of about 20 nucleotides or less than about 20 nucleotides (e.g., at least about 5, 10, 15, 16, 17, 18, 19, 20, 21, 22, 23, 24, 25, 30 nucleotides), or anywhere between about 1-100 nucleotides (e.g., 5, 10, 15, 16, 17, 18, 19, 20, 21, 22, 23, 24, 25, 30, 40, 50, 60, 70, 80, 90, 100). A target nucleic acid sequence can be or can be about 20 bases immediately 5' of the first nucleotide of the PAM. A gRNA can target a nucleic acid sequence. A target nucleic acid can be at least or at least about 1-10, 1-20, 1-30, 1-40, 1-50, 1-60, 1-70, 1-80, 1-90, or 1-100 nucleotides.

Methods for selecting, designing, and validating guide polynucleotides, e.g., gRNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on single strand DNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a gRNA for use with Cas9s may be identified using a DNA sequence searching algorithm. gRNA design is carried out using custom gRNA design software based on the public tool cas-OFFinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g., a target gene may be obtained and repeat elements may be screened using publicly available tools, for example, the RepeatMasker program. RepeatMasker searches input DNA sequences for repeated elements and regions of low complexity. The output is a detailed annotation of the repeats present in a given query sequence.

Following identification, first regions of gRNAs, e.g., crRNAs, are ranked into tiers based on their distance to the target site, their orthogonality and presence of 5' nucleotides for close matches with relevant PAM sequences (for example, a 5. G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A “high level of orthogonality” or “good orthogonality” may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

A gRNA can then be introduced into a cell or embryo as an RNA molecule or a non-RNA nucleic acid molecule, e.g., DNA molecule. In one embodiment, a DNA encoding a gRNA is operably linked to promoter control sequence for expression of the gRNA in a cell or embryo of interest. A RNA coding sequence can be operably linked to a promoter sequence that is recognized by RNA polymerase III (Pol III). Plasmid vectors that can be used to express gRNA include, but are not limited to, px330 vectors and px333 vectors. In some cases, a plasmid vector (e.g., px333 vector) can comprise at least two gRNA-encoding DNA sequences. Further, a vector can comprise additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a gRNA can also be linear. A DNA molecule encoding a gRNA or a guide polynucleotide can also be circular.

In some embodiments, a reporter system is used for detecting base-editing activity and testing candidate guide polynucleotides. In some embodiments, a reporter system comprises a reporter gene based assay where base editing activity leads to expression of the reporter gene. For example, a reporter system may include a reporter gene comprising a deactivated start codon, e.g., a mutation on the template strand from 3'-TAC-5' to 3'-CAC-S'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g., a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

In some embodiments, a base editor system may comprise multiple guide polynucleotides, e.g., gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. The multiple gRNA sequences can be tandemly arranged and are preferably separated by a direct repeat.

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some cases, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some cases, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by S' adenylate, 5' guanosine-triphosphate cap, 5' N7-Methylguanosine-triphosphate cap, 5' triphosphate cap, 3' phosphate, 3' thiophosphate, 5' phosphate, 5' thiophosphate, Cis-Syn thymidine dimer, trimers, C12 spacer, C3 spacer, C6 spacer, dSpacer, PC spacer, rSpacer, Spacer 18, Spacer 9, 3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3' DABCYL, black hole quencher 1, black hole quencher 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some cases, a modification is permanent. In other cases, a modification is transient. In some cases, multiple modifications are made to a gRNA or a guide polynucleotide A gRNA or a guide polynucleotide modification can alter physiochemical properties of a nucleotide, such as their conformation, polarity, hydrophobicity, chemical reactivity, base-pairing interactions, or any combination thereof.

A guide polynucleotide can be transferred into a cell by transfecting the cell with an isolated gRNA or a plasmid DNA comprising a sequence coding for the guide RNA and a promoter. A gRNA or a guide polynucleotide can also be transferred into a cell in other way, such as using virus-mediated gene delivery. A gRNA or a guide polynucleotide can be isolated. For example, a gRNA can be transfected in the form of an isolated RNA into a cell or organism. A gRNA can be prepared by in vitro transcription using any in vitro transcription system known in the art. A gRNA can be transferred to a cell in the form of isolated RNA rather than in the form of plasmid comprising encoding sequence for a gRNA.

A modification can also be a phosphorothioate substitute. In some cases, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some cases, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or 3'-end of a gRNA which can inhibit exonuclease degradation. In some cases, phosphorothioate bonds can be added throughout an entire gRNA to reduce attack by endonucleases.

In some embodiments, the guide RNA is designed to disrupt a splice site (i.e., a splice acceptor (SA) or a splice donor (SD). In some embodiments, the guide RNA is designed such that the base editing results in a premature STOP codon.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer). The PAM sequence is essential for target binding, but the exact sequence depends on a type of Cas protein. The PAM sequence can be any PAM sequence known in the art. Suitable PAM sequences include, but are not limited to, NGG, NGA, NGC, NGN, NGT, NGTT, NGCG, NGAG, NGAN, NGNG, NGCN, NGCG, NGTN, NNGRRT, NNNRRT, NNGRR(N), TTTV, TYCV, TYCV, TATV, NNNNGATT, NNAGAAW, or NAAAAC. Y is a pyrimidine; Nis any nucleotide base; W is A or T.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities.

For example, typically Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

In some embodiments, the PAM is an "NRN" PAM where the "N" in "NRN" is adenine (A), thymine (T), guanine (G), or cytosine (C), and the R is adenine (A) or guanine (G); or the PAM is an "NYN" PAM, wherein the "N" in NYN is adenine (A), thymine (T), guanine (G), or cytosine (C), and the Y is cytidine (C) or thymine (T), for example, as described in R. T. Walton et al., 2020, *Science,* 10.1126/science.aba8853 (2020), the entire contents of which are incorporated herein by reference.

Several PAM variants are described in Table 7 below

TABLE 7

Cas9 proteins and corresponding PAM sequences

| Variant | PAM |
|---|---|
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| spCas9-MQKFRAER | NGC |
| Cpf1 | 5' (TTTV) |
| SpyMac | 5'-NAA-3' |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the PAM is NGT. In some embodiments, the NGT PAM is recognized by a Cas9 variant. In some embodiments, the NGT PAM variant is generated through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 8A and 8B below.

TABLE 8A

NGT PAM Variant Mutations at residues 1219, 1335, 1337, 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 8B

NGT PAM Variant Mutations at residues 1135, 1136, 1218, 1219, and 1335

| Variant | D1135L | S1136R | G1218S | E1219V | R1335Q |
|---|---|---|---|---|---|
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Table 8A and Table 8B. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 9 below.

TABLE 9

| NGT PAM Variant Mutations at residues 1219, 1335, 1337, and 1218 | | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, the NGT PAM is selected from the variants provided in Table 10 below.

TABLE 10

| NGT PAM variants | | | | | | | | |
|---|---|---|---|---|---|---|---|---|
| | NGTN variant | D1135 | S1136 | G1218 | E1219 | A1322R | R1335 | T1337 |
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135V, a R1335Q, and a T1337R mutation, or a corresponding mutation in any of the amino acid sequences provided herein. In some embodiments, the SpCas9 domain comprises a D1135V, a R1335Q, and a T1337R mutation, or corresponding mutations in any of the amino acid sequences provided herein. In some embodiments, the SpCas9 domain comprises one or more of a D1135X, a G1218X, a R1335X, and a T1337X mutation, or a corresponding mutation in any of the amino acid sequences provided herein, wherein X is any amino acid. In some embodiments, the SpCas9 domain comprises one or more of a D1135V, a G1218R, a R1335Q, and a T1337R mutation, or a corresponding mutation in any of the amino acid sequences provided herein. In some embodiments, the SpCas9 domain comprises a D1135V, a G1218R, a R1335Q, In some embodiments the NGTN variant is variant 1. In some embodiments, the NGTN variant is variant 2. In some embodiments, the NGTN variant is variant 3. In some embodiments, the NGTN variant is variant 4. In some embodiments, the NGTN variant is variant 5. In some embodiments, the NGTN variant is variant 6.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence.

In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135E, R1335Q, and T1337R mutation, or a corresponding mutation in any of the amino acid sequences provided herein. In some embodiments, the SpCas9 domain comprises a D1135E, a R1335Q, and a T1337R mutation, or corresponding mutations in any of the amino acid sequences provided herein. In some embodiments, the SpCas9 domain and a T1337R mutation, or corresponding mutations in any of the amino acid sequences provided herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these “non-SpCas9s” can bind a variety of PAM sequences that can also be useful for the present disclosure. For example, the relatively large size of SpCas9 (approximately 4 kb coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus*

(S'-NNAGAA for CRISPR1 and 5'-NGGNG for CRISPR3) and *Neisseria meningitidis* (5'-NNNNGATT) can also be found adjacent to a target gene.

In some embodiments, for a *S. pyogenes* system, a target gene sequence can precede (i.e., be 5' to) a S'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

In some embodiments, engineered SpCas9 variants are capable of recognizing protospacer adjacent motif (PAM) sequences flanked by a 3. H (non-G PAM) (see Tables 3A-3D). In some embodiments, the SpCas9 variants recognize NRNH PAMs (where R is A or G and His A, C or T). In some embodiments, the non-G PAM is NRRH, NRTH, or NRCH (see e.g., Miller, S. M., et al. Continuous evolution of SpCas9 variants compatible with non-G PAMs, Nat. Biotechnol. (2020), the contents of which is incorporated herein by reference in its entirety).

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

The sequence of an exemplary Cas9 A homolog of Spy Cas9 in *Streptococcus macacae* with native 5'-NAAN-3' PAM specificity is known in the art and described, for example, by Chatterjee, et al., "A Cas9 with PAM recognition for adenine dinucleotides", *Nature Communications*, vol. 11, article no. 2474 (2020), and is in the Sequence Listing as SEQ ID NO: 237.

In some embodiments, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" *Nature* Biotechnology 33, 1293-1298 (2015); R. T. Walton et al. "Unconstrained genome targeting with near-PAMless engineered CRISPR-Cas9 variants" *Science* 10.1126/science.aba8853 (2020); Hu et al. "Evolved Cas9 variants with broad PAM compatibility and high DNA specificity," *Nature,* 2018 Apr. 5, 556 (7699), 57-63; Miller et al., "Continuous evolution of SpCas9 variants compatible with non-G PAMs" *Nat. Biotechnol.,* 2020 April; 38 (4): 471-481; the entire contents of each are hereby incorporated by reference.

Fusion Proteins Comprising a NapDNAbp and a Cytidine Deaminase and/or Adenosine Deaminase Some aspects of the disclosure provide fusion proteins comprising a Cas9 domain or other nucleic acid programmable DNA binding protein (e.g., Cas12) and one or more cytidine deaminase or adenosine deaminase domains. It should be appreciated that the Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases and/or adenosine deaminases provided herein. The domains of the base editors disclosed herein can be arranged in any order.

In some embodiments, the fusion protein comprises the following domains A-C, A-D, or A-E:

$NH_2$-[A-B-C]—COOH, $NH_2$-[A-B-C-D]-COOH; or $NH_2$-[A-B-C-D-E]-COOH;

wherein A and C or A, C, and E, each comprises one or more of the following:

an adenosine deaminase domain or an active fragment thereof, a cytidine deaminase domain or an active fragment thereof, and wherein B or B and D, each comprises one or more domains having nucleic acid sequence specific binding activity.

In some embodiments, the fusion protein comprises the following structure:

$NH_2$-[$A_n$-$B_o$—$C_n$]—COOH;

$NH_2$-[$A_n$-$B_o$—$C_n$-$D_o$]—COOH; or $NH_2$-[$A_n$-$B_o$—$C_p$-$D_o$-$E_q$]—COOH;

wherein A and C or A, C, and E, each comprises one or more of the following:

an adenosine deaminase domain or an active fragment thereof, a cytidine deaminase domain or an active fragment thereof, and wherein n is an integer: 1, 2, 3, 4, or 5, wherein p is an integer: 0, 1, 2, 3, 4, or 5; wherein q is an integer 0, 1, 2, 3, 4, or 5; and wherein B or B and D each comprises a domain having nucleic acid sequence specific binding activity; and wherein o is an integer: 1, 2, 3, 4, or 5.

For example, and without limitation, in some embodiments, the fusion protein comprises the structure:

NH2-[adenosine deaminase]-[Cas9 domain]-COOH;
NH2-[Cas9 domain]-[adenosine deaminase]-COOH;
NH2-[cytidine deaminase]-[Cas9 domain]-COOH;
NH2-[Cas9 domain]-[cytidine deaminase]-COOH;
NH2-[cytidine deaminase]-[Cas9 domain]-[adenosine deaminase]-COOH;
NH2-[adenosine deaminase]-[Cas9 domain]-[cytidine deaminase]-COOH;
NH2-[adenosine deaminase]-[cytidine deaminase]-[Cas9 domain]-COOH;
NH2-[cytidine deaminase]-[adenosine deaminase]-[Cas9 domain]-COOH;
NH2-[Cas9 domain]-[adenosine deaminase]-[cytidine deaminase]-COOH; or
NH2-[Cas9 domain]-[cytidine deaminase]-[adenosine deaminase]-COOH.

In some embodiments, any of the Cas12 domains or Cas12 proteins provided herein may be fused with any of the cytidine or adenosine deaminases provided herein. For example, and without limitation, in some embodiments, the fusion protein comprises the structure:

NH2-[adenosine deaminase]-[Cas12 domain]-COOH;
NH2-[Cas12 domain]-[adenosine deaminase]-COOH;
NH2-[cytidine deaminase]-[Cas12 domain]-COOH;
NH2-[Cas12 domain]-[cytidine deaminase]-COOH,
NH2-[cytidine deaminase]-[Cas12 domain]-[adenosine deaminase]-COOH;
NH2-[adenosine deaminase]-[Cas12 domain]-[cytidine deaminase]-COOH;
NH2-[adenosine deaminase]-[cytidine deaminase]-[Cas12 domain]-COOH;
NH2-[cytidine deaminase]-[adenosine deaminase]-[Cas12 domain]-COOH;
NH2-[Cas12 domain]-[adenosine deaminase]-[cytidine deaminase]-COOH; or
NH2-[Cas12 domain]-[cytidine deaminase]-[adenosine deaminase]-COOH.

In some embodiments, the adenosine deaminase is a TadA*8. Exemplary fusion protein structures include the following:

NH2-[TadA*8]-[Cas9 domain]-COOH;
NH2-[Cas9 domain]-[TadA*8]—COOH;
NH2-[TadA*8]-[Cas12 domain]-COOH; or
NH2-[Cas12 domain]-[TadA*8]—COOH.

In some embodiments, the adenosine deaminase of the fusion protein comprises a TadA*8 and a cytidine deaminase and/or an adenosine deaminase. In some embodiments, the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

Exemplary fusion protein structures include the following:

NH2-[TadA*8]-[Cas9/Cas12]-[adenosine deaminase]-COOH;
NH2-[adenosine deaminase]-[Cas9/Cas12]-[TadA*8]—COOH;
NH2-[TadA*8]-[Cas9/Cas12]-[cytidine deaminase]-COOH; or
NH2-[cytidine deaminase]-[Cas9/Cas12]-[TadA*8]—COOH.

In some embodiments, the adenosine deaminase of the fusion protein comprises a TadA*9 and a cytidine deaminase and/or an adenosine deaminase. Exemplary fusion protein structures include the following:

NH2-[TadA*9]-[Cas9/Cas12]-[adenosine deaminase]-COOH;
NH2-[adenosine deaminase]-[Cas9/Cas12]-[TadA*9]—COOH;
NH2-[TadA*9]-[Cas9/Cas12]-[cytidine deaminase]-COOH; or
NH2-[cytidine deaminase]-[Cas9/Cas12]-[TadA*9]—COOH.

In some embodiments, the fusion protein can comprise a deaminase flanked by an N-terminal fragment and a C-terminal fragment of a Cas9 or Cas12 polypeptide. In some embodiments, the fusion protein comprises a cytidine deaminase flanked by an N-terminal fragment and a C-terminal fragment of a Cas9 or Cas12 polypeptide. In some embodiments, the fusion protein comprises an adenosine deaminase flanked by an N-terminal fragment and a C-terminal fragment of a Cas9 or Cas12 polypeptide.

In some embodiments, the fusion proteins comprising a cytidine deaminase or adenosine deaminase and a napDNAbp (e.g., Cas9 or Cas12 domain) do not include a linker sequence. In some embodiments, a linker is present between the cytidine or adenosine deaminase and the napDNAbp. In some embodiments, the "-" used in the general architecture above indicates the presence of an optional linker. In some embodiments, cytidine or adenosine deaminase and the napDNAbp are fused via any of the linkers provided herein. For example, in some embodiments the cytidine or adenosine deaminase and the napDNAbp are fused via any of the linkers provided herein.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of skill in the art. In some embodiments, the fusion protein comprises one or more His tags.

Exemplary, yet nonlimiting, fusion proteins are described in International PCT Application Nos. PCT/2017/044935, PCT/US2019/044935, and PCT/US2020/016288, each of which is incorporated herein by reference for its entirety.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, the NLS is fused to the N-terminus or the C-terminus of the fusion protein. In some embodiments, the NLS is fused to the C-terminus or N-terminus of an nCas9 domain or a dCas9 domain. In some embodiments, the NLS is fused to the N-terminus or C-terminus of the Cas12 domain. In some embodiments, the NLS is fused to the N-terminus or C-terminus of the cytidine or adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFESPKKKRKV (SEQ ID NO: 328), KRTADGSEFESPKKKRKV (SEQ ID NO: 190), KRPAATKKAGQAKKKK (SEQ ID NO: 191), KKTELQTTNAENKTKKL (SEQ ID NO: 192), KRGINDRNFWRGENGRKTR (SEQ ID NO: 193), RKSGKIAAIVVKRPRKPKKKRKV (SEQ ID NO: 329), or MDSLLMNRRKFLYQFKNVRWAKGRRETYLC (SEQ ID NO: 196).

In some embodiments, the fusion proteins comprising a cytidine or adenosine deaminase, a Cas9 domain, and an NLS do not comprise a linker sequence. In some embodiments, linker sequences between one or more of the domains or proteins (e.g., cytidine or adenosine deaminase, Cas9 domain or NLS) are present. In some embodiments, a linker is present between the cytidine deaminase and adenosine deaminase domains and the napDNAbp. In some embodiments, the "-" used in the general architecture below indicates the presence of an optional linker. In some embodiments, the cytidine deaminase and adenosine deaminase and the napDNAbp are fused via any of the linkers provided herein. For example, in some embodiments the cytidine deaminase and adenosine deaminase and the napDNAbp are fused via any of the linkers provided herein.

In some embodiments, the general architecture of exemplary napDNAbp (e.g., Cas9 or Cas12) fusion proteins with a cytidine or adenosine deaminase and a napDNAbp (e.g., Cas9 or Cas12) domain comprises any one of the following structures, where NLS is a nuclear localization sequence (e.g., any NLS provided herein), NH2 is the N-terminus of the fusion protein, and COOH is the C-terminus of the fusion protein:

$NH_2$-NLS-[cytidine deaminase]-[napDNAbp domain]-COOH;

$NH_2$-NLS [napDNAbp domain]-[cytidine deaminase]-COOH,

NH2-[cytidine deaminase]-[napDNAbp domain]-NLS-COOH;

$NH_2$-[napDNAbp domain]-[cytidine deaminase]-NLS-COOH, $NH_2$-NLS-[adenosine deaminase]-[napDNAbp domain]-COOH;

$NH_2$-NLS [napDNAbp domain]-[adenosine deaminase]-COOH;

$NH_2$-[adenosine deaminase]-[napDNAbp domain]-NLS-COOH;

$NH_2$-[napDNAbp domain]-[adenosine deaminase]-NLS-COOH;

$NH_2$-NLS-[cytidine deaminase]-[napDNAbp domain]-[adenosine deaminase]-COOH;

$NH_2$-NLS-[adenosine deaminase]-[napDNAbp domain]-[cytidine deaminase]-COOH;

$NH_2$-NLS-[adenosine deaminase] [cytidine deaminase]-[napDNAbp domain]-COOH;

$NH_2$-NLS-[cytidine deaminase]-[adenosine deaminase]-[napDNAbp domain]-COOH;

$NH_2$-NLS-[napDNAbp domain]-[adenosine deaminase]-[cytidine deaminase]-COOH;

$NH_2$-NLS-[napDNAbp domain]-[cytidine deaminase]-[adenosine deaminase]-COOH;

$NH_2$-[cytidine deaminase]-[napDNAbp domain]-[adenosine deaminase]-NLS-COOH;

$NH_2$-[adenosine deaminase]-[napDNAbp domain]-[cytidine deaminase]-NLS-COOH;

$NH_2$-[adenosine deaminase] [cytidine deaminase]-[napDNAbp domain]-NLS-COOH;

$NH_2$-[cytidine deaminase]-[adenosine deaminase]-[napDNAbp domain]-NLS-COOH;

$NH_2$-[napDNAbp domain]-[adenosine deaminase]-[cytidine deaminase]-NLS-COOH; or $NH_2$-[napDNAbp domain]-[cytidine deaminase]-[adenosine deaminase]-NLS-COOH. In some embodiments, the NLS is present in a linker or the NLS is flanked by linkers, for example described herein. A bipartite NLS comprises two basic amino acid clusters, which are separated by a relatively short spacer sequence (hence bipartite-2 parts, while monopartite NLSs are not). The NLS of nucleoplasmin, KR [PAATKKAGQA] KKKK (SEQ ID NO: 191), is the prototype of the ubiquitous bipartite signal: two clusters of basic amino acids, separated by a spacer of about 10 amino acids. The sequence of an exemplary bipartite NLS follows: PKKKRKVEGADKRTADGSEFESPKKKRKV (SEQ ID NO: 328)

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the amino-terminus, about or more than about 1, 2, 3, 4, 5, 6, 7, 8, 9, 10 NLSs at or near the carboxy-terminus, or any combination thereof (e.g., one or more NLS at the amino-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some embodiments, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise an uracil glycosylase inhibitor (UGI) domain. In some embodiments, cellular DNA repair response to the presence of U:G heteroduplex DNA can be responsible for a decrease in nucleobase editing efficiency in cells. In such embodiments, uracil DNA glycosylase (UDG) can catalyze removal of U from DNA in cells, which can initiate base excision repair (BER), mostly resulting in reversion of the U:G pair to a C:G pair. In such embodiments, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

Additionally, in some embodiments, a Gam protein can be fused to an N terminus of a base editor. In some embodiments, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See Komor, A. C., et al., "Improved base excision repair inhibition and bacteriophage Mu Gam protein yields C:G-to-T:A base editors with higher efficiency and product purity" Science Advances 3:eaao4774 (2017). In some embodiments, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitutions in any domain does not change the length of the base editor.

Non-limiting examples of such base editors, where the length of all the domains is the same as the wild type domains, can include.

NH2-[nucleobase editing domain]-Linker1-[APOBEC1]-Linker2-[nucleobase editing domain]-COOH;

NH2-[nucleobase editing domain]-Linker1-[APOBEC1]-[nucleobase editing domain]-COOH;

NH2-[nucleobase editing domain]-[APOBEC1]-Linker2-[nucleobase editing domain]-COOH;

NH2-[nucleobase editing domain]-[APOBEC1]-[nucleobase editing domain]-COOH,

NH2-[nucleobase editing domain]-Linker1-[APOBEC1]-Linker2-[nucleobase editing domain]-[UGI]—COOH;

NH2-[nucleobase editing domain]-Linker1-[APOBEC1]-[nucleobase editing domain]-[UGI]—COOH;

NH2-[nucleobase editing domain]-[APOBEC1]-Linker2-[nucleobase editing domain]-[UGI]—COOH;

NH2-[nucleobase editing domain]-[APOBEC1]-[nucleobase editing domain]-[UGI]—COOH;

NH2-[UGI]-[nucleobase editing domain]-Linker1-[APOBEC1]-Linker2-[nucleobase editing domain]-COOH;

NH2-[UGI]-[nucleobase editing domain]-Linker1-[APOBEC1]-[nucleobase editing domain]-COOH;

NH2-[UGI]-[nucleobase editing domain]-[APOBEC1]-Linker2-[nucleobase editing domain]-COOH; or NH2-[UGI]-[nucleobase editing domain]-[APOBEC1]-[nucleobase editing domain]-COOH.

Base Editor System

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system is a cytidine base editor (CBE) or an adenosine base editor (ABE). In some embodiments, the polynucleotide programmable nucleotide binding domain is a polynucleotide programmable DNA or RNA binding domain. In some embodiments, the nucleobase editing domain is a deaminase domain. In some embodiments, a deaminase domain can be a cytidine deaminase or an cytosine deaminase. In some embodiments, a deaminase domain can be an adenine deaminase or an adenosine deaminase. In some embodiments, the adenosine base editor can deaminate adenine in DNA. In some embodiments, the base editor is capable of deaminating a cytidine in DNA.

In some embodiments, a base editing system as provided herein provides a new approach to genome editing that uses a fusion protein containing a catalytically defective *Streptococcus pyogenes* Cas9, a deaminase (e.g., cytidine or adenosine deaminase), and an inhibitor of base excision repair to induce programmable, single nucleotide (C• T or A• G) changes in DNA without generating double-strand DNA breaks, without requiring a donor DNA template, and without inducing an excess of stochastic insertions and deletions.

Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

Use of the base editor system provided herein comprises the steps of: (a) contacting a target nucleotide sequence of a polynucleotide (e.g., double- or single stranded DNA or RNA) of a subject with a base editor system comprising a nucleobase editor (e.g., an adenosine base editor or a cytidine base editor) and a guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

In some embodiments, a single guide polynucleotide may be utilized to target a deaminase to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or an RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif.

In some embodiments, the base editor inhibits base excision repair (BER) of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the base editing fusion proteins provided herein need to be positioned at a precise location, for example, where a target base is placed within a defined region (e.g., a "deamination window"). In some embodiments, a target can be within a 4 base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide programmable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of skill in the art. In some embodiments, the fusion protein comprises one or more His tags.

In some embodiments, non-limiting exemplary cytidine base editors (CBE) include BE1 (APOBEC1-XTEN-dCas9), BE2 (APOBEC1-XTEN-dCas9-UGI), BE3 (APOBEC1-XTEN-dCas9 (A840H)-UGI), BE3-Gam, saBE3, saBE4-Gam, BE4, BE4-Gam, saBE4, or saB4E-Gam. BE4 extends the APOBEC1-Cas9n (D10A) linker to 32 amino acids and the Cas9n-UGI linker to 9 amino acids, and appends a second copy of UGI to the C-terminus of the construct with another 9-amino acid linker into a single base editor construct. The base editors saBE3 and saBE4 have the *S. pyogenes* Cas9n (D10A) replaced with the smaller *S. aureus* Cas9n (D10A). BE3-Gam, saBE3-Gam, BE4-Gam, and saBE4-Gam have 174 residues of Gam protein fused to the N-terminus of BE3, saBE3, BE4, and saBE4 via the 16 amino acid XTEN linker.

In some embodiments, the adenosine base editor (ABE) can deaminate adenine in DNA. In some embodiments, ABE is generated by replacing APOBEC1 component of BE3 with natural or engineered *E. coli* TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of *E. coli* Endo V (inactivated with D35A mutation). In some embodiments, the ABE is ABE2.6 which has a linker twice as long (32 amino acids, $(SGGS)_2$ (SEQ ID NO: 330)-XTEN-$(SGGS)_2$ (SEQ ID NO: 330)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild-type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I156F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type *E. coli* TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in Table 11 below. In some embodiments, the ABE is a sixth generation ABE. In some embodiments, the ABE is ABE6.1, ABE6.2, ABE6.3, ABE6.4, ABE6.5, or ABE6.6, as shown in Table 11 below. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in Table 11 below.

TABLE 11

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 106 | 108 | 123 | 125 | 142 | 146 | 147 | 152 | 155 | 156 | 157 | 161 |
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | F | N | K |
| ABE5.4 | W | R | H | S | P | | R | N | F | S | V | N | Y | G | A | S | Y | R | V | F | K | T |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |

TABLE 11-continued

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 106 | 108 | 123 | 125 | 142 | 146 | 147 | 152 | 155 | 156 | 157 | 161 |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | N | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | T | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | L | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | F | N | K |
| ABE7.7 | L | R | L | N | A | | L | N | F | S | V | N | Y | G | A | C | Y | P | V | F | N | K |
| ABE7.8 | L | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is an eighth generation ABE (ABE8). In some embodiments, the ABE8 contains a TadA*8 variant. In some embodiments, the ABE8 has a monomeric construct containing a TadA*8 variant ("ABE8.x-m"). In some embodiments, the ABE8 is ABE8.1-m, which has a monomeric construct containing TadA*7.10 with a Y147T mutation (TadA*8.1). In some embodiments, the ABE8 is ABE8.2-m, which has a monomeric construct containing TadA*7.10 with a Y147R mutation (TadA*8.2). In some embodiments, the ABE8 is ABE8.3-m, which has a monomeric construct containing TadA*7.10 with a Q154S mutation (TadA*8.3). In some embodiments, the ABE8 is ABE8.4-m, which has a monomeric construct containing TadA*7.10 with a Y123H mutation (TadA*8.4). In some embodiments, the ABE8 is ABE8.5-m, which has a monomeric construct containing TadA*7.10 with a V82S mutation (TadA*8.5). In some embodiments, the ABE8 is ABE8.6-m, which has a monomeric construct containing TadA*7.10 with a T166R mutation (TadA*8.6). In some embodiments, the ABE8 is ABE8.7-m, which has a monomeric construct containing TadA*7.10 with a Q154R mutation (TadA*8.7). In some embodiments, the ABE8 is ABE8.8-m, which has a monomeric construct containing TadA*7.10 with Y147R, Q154R, and Y123H mutations (TadA*8.8). In some embodiments, the ABE8 is ABE8.9-m, which has a monomeric construct containing TadA*7.10 with Y147R, Q154R and I76Y mutations (TadA*8.9). In some embodiments, the ABE8 is ABE8.10-m, which has a monomeric construct containing TadA*7.10 with Y147R, Q154R, and T166R mutations (TadA*8.10). In some embodiments, the ABE8 is ABE8.11-m, which has a monomeric construct containing TadA*7.10 with Y147T and Q154R mutations (TadA*8.11). In some embodiments, the ABE8 is ABE8.12-m, which has a monomeric construct containing TadA*7.10 with Y147T and Q154S mutations (TadA*8.12).

In some embodiments, the ABE8 is ABE8.13-m, which has a monomeric construct containing TadA*7.10 with Y123H (Y123H reverted from H123Y), Y147R, Q154R and I76Y mutations (TadA*8.13). In some embodiments, the ABE8 is ABE8.14-m, which has a monomeric construct containing TadA*7.10 with 176Y and V82S mutations (TadA*8.14). In some embodiments, the ABE8 is ABE8.15-m, which has a monomeric construct containing TadA*7.10 with V82S and Y147R mutations (TadA*8.15). In some embodiments, the ABE8 is ABE8.16-m, which has a monomeric construct containing TadA*7.10 with V82S, Y123H (Y123H reverted from H123Y) and Y147R mutations (TadA*8.16). In some embodiments, the ABE8 is ABE8.17-m, which has a monomeric construct containing TadA*7.10 with V82S and Q154R mutations (TadA*8.17). In some embodiments, the ABE8 is ABE8.18-m, which has a monomeric construct containing TadA*7.10 with V82S, Y123H (Y123H reverted from H123Y) and Q154R mutations (TadA*8.18). In some embodiments, the ABE8 is ABE8.19-m, which has a monomeric construct containing TadA*7.10 with V82S, Y123H (Y123H reverted from H123Y), Y147R and Q154R mutations (TadA*8.19). In some embodiments, the ABE8 is ABE8.20-m, which has a monomeric construct containing TadA*7.10 with 176Y, V82S, Y123H (Y123H reverted from H123Y), Y147R and Q154R mutations (TadA*8.20). In some embodiments, the ABE8 is ABE8.21-m, which has a monomeric construct containing TadA*7.10 with Y147R and Q154S mutations (TadA*8.21). In some embodiments, the ABE8 is ABE8.22-m, which has a monomeric construct containing TadA*7.10 with V82S and Q154S mutations (TadA*8.22). In some embodiments, the ABE8 is ABE8.23-m, which has a monomeric construct containing TadA*7.10 with V82S and Y123H (Y123H reverted from H123Y) mutations (TadA*8.23). In some embodiments, the ABE8 is ABE8.24-m, which has a monomeric construct containing TadA*7.10 with V82S, Y123H (Y123H reverted from H123Y), and Y147T mutations (TadA*8.24).

In some embodiments, the ABE8 has a heterodimeric construct containing wild-type *E. coli* TadA fused to a TadA*8 variant ("ABE8.x-d"). In some embodiments, the ABE8 is ABE8.1-d, which has a heterodimeric construct containing wild-type *E. coli* TadA fused to TadA*7.10 with a Y147T mutation (TadA*8.1). In some embodiments, the ABE8 is ABE8.2-d, which has a heterodimeric construct containing wild-type *E. coli* TadA fused to TadA*7.10 with a Y147R mutation (TadA*8.2). In some embodiments, the ABE8 is ABE8.3-d, which has a heterodimeric construct containing wild-type *E. coli* TadA fused to TadA*7.10 with a Q154S mutation (TadA*8.3). In some embodiments, the ABE8 is ABE8.4-d, which has a heterodimeric construct containing wild-type *E. coli* TadA fused to TadA*7.10 with a Y123H mutation (TadA*8.4). In some embodiments, the ABE8 is ABE8.5-d, which has a heterodimeric construct containing wild-type *E. coli* TadA fused to TadA*7.10 with a V82S mutation (TadA*8.5). In some embodiments, the ABE8 is ABE8.6-d, which has a heterodimeric construct containing wild-type *E. coli* TadA fused to TadA*7.10 with a T166R mutation (TadA*8.6). In some embodiments, the ABE8 is ABE8.7-d, which has a heterodimeric construct containing wild-type *E. coli* TadA fused to TadA*7.10 with a Q154R mutation (TadA*8.7) In some embodiments, the ABE8 is ABE8.8-d, which has a heterodimeric construct containing wild-type *E. coli* TadA fused to TadA*7.10 with Y147R, Q154R, and Y123H mutations (TadA*8.8). In some embodiments, the ABE8 is ABE8.9-d, which has a heterodimeric construct containing wild-type *E. coli* TadA fused to TadA*7.10 with Y147R, Q154R and 176Y mutations (TadA*8.9). In some embodiments, the ABE8 is ABE8.10-d, which has a heterodimeric construct containing wild-type *E. coli* TadA fused to TadA*7.10 with Y147R, Q154R, and T166R mutations (TadA*8.10) In some embodiments, the ABE8 is ABE8.11-d, which has a heterodimeric construct containing wild-type *E. coli* TadA fused to TadA*7.10 with Y147T and Q154R mutations (TadA*8.11). In some embodiments, the ABE8 is ABE8.12-d, which has heterodimeric construct containing wild-type *E. coli* TadA fused to TadA*7.10 with Y147T and Q154S mutations (TadA*8.12). In some embodiments, the ABE8 is ABE8.13-d, which has a heterodimeric construct containing wild-type *E. coli* TadA fused to TadA*7.10 with Y123H (Y123H reverted from H123Y), Y147R, Q154R and I76Y mutations (TadA*8.13). In some embodiments, the ABE8 is ABE8.14-d, which has a heterodimeric construct containing wild-type *E. coli* TadA fused to TadA*7.10 with 176Y and V82S mutations (TadA*8.14). In some embodiments, the ABE8 is ABE8.15-d, which has a heterodimeric construct containing wild-type *E. coli* TadA fused to TadA*7.10 with V82S and Y147R mutations (TadA*8.15). In some embodiments, the ABE8 is ABE8.16-d, which has a heterodimeric construct containing wild-type *E. coli* TadA fused to TadA*7.10 with V82S, Y123H (Y123H reverted from H123Y) and Y147R mutations (TadA*8.16). In some embodiments, the ABE8 is ABE8.17-d, which has a heterodimeric construct containing wild-type *E. coli* TadA fused to TadA*7.10 with V82S and Q154R mutations (TadA*8.17). In some embodiments, the ABE8 is ABE8.18-d, which has a heterodimeric construct containing wild-type *E. coli* TadA fused to TadA*7.10 with V82S, Y123H (Y123H reverted from H123Y) and Q154R mutations (TadA*8.18). In some embodiments, the ABE8 is ABE8.19-d, which has a heterodimeric construct containing wild-type *E. coli* TadA fused to TadA*7.10 with V82S, Y123H (Y123H reverted from H123Y), Y147R and Q154R mutations (TadA*8.19). In some embodiments, the ABE8 is ABE8.20-d, which has a heterodimeric construct containing wild-type *E. coli* TadA fused to TadA*7.10 with I76Y, V82S, Y123H (Y123H reverted from H123Y), Y147R and Q154R mutations (TadA*8.20). In some embodiments, the ABE8 is ABE8.21-d, which has a heterodimeric construct containing wild-type *E. coli* TadA fused to TadA*7.10 with Y147R and Q154S mutations (TadA*8.21). In some embodiments, the ABE8 is ABE8.22-d, which has a heterodimeric construct containing wild-type *E. coli* TadA fused to TadA*7.10 with V82S and Q154S mutations (TadA*8.22). In some embodiments, the ABE8 is ABE8.23-d, which has a heterodimeric construct containing wild-type *E. coli* TadA fused to TadA*7.10 with V82S and Y123H (Y123H reverted from H123Y) mutations (TadA*8.23). In some embodiments, the ABE8 is ABE8.24-d, which has a heterodimeric construct containing wild-type *E. coli* TadA fused to TadA*7.10 with V82S, Y123H (Y123H reverted from H123Y), and Y147T mutations (TadA*8.24).

In some embodiments, the ABE8 has a heterodimeric construct containing TadA*7.10 fused to a TadA*8 variant ("ABE8 x-7"). In some embodiments, the ABE8 is ABE8.1-7, which has a heterodimeric construct containing TadA*7.10 fused to TadA*7.10 with a Y147T mutation (TadA*8.1). In some embodiments, the ABE8 is ABE8.2-7, which has a heterodimeric construct containing TadA*7.10 fused to TadA*7.10 with a Y147R mutation (TadA*8.2). In some embodiments, the ABE8 is ABE8.3-7, which has a heterodimeric construct containing TadA*7.10 fused to TadA*7.10 with a Q154S mutation (TadA*8.3). In some embodiments, the ABE8 is ABE8.4-7, which has a heterodimeric construct containing TadA*7.10 fused to TadA*7.10 with a Y123H mutation (TadA*8.4). In some embodiments, the ABE8 is ABE8.5-7, which has a heterodimeric construct containing TadA*7.10 fused to TadA*7.10 with a V82S mutation (TadA*8.5). In some embodiments, the ABE8 is ABE8.6-7, which has a heterodimeric construct containing TadA*7.10 fused to TadA*7.10 with a T166R mutation (TadA*8.6). In some embodiments, the ABE8 is ABE8.7-7, which has a heterodimeric construct containing TadA*7.10 fused to TadA*7.10 with a Q154R mutation (TadA*8.7). In some embodiments, the ABE8 is ABE8.8-7, which has a heterodimeric construct containing TadA*7.10 fused to TadA*7.10 with Y147R, Q154R, and Y123H mutations (TadA*8.8). In some embodiments, the ABE8 is ABE8.9-7, which has a heterodimeric construct containing TadA*7.10 fused to TadA*7.10 with Y147R, Q154R and 176Y mutations (TadA*8.9). In some embodiments, the ABE8 is ABE8.10-7, which has a heterodimeric construct containing TadA*7.10 fused to TadA*7.10 with Y147R, Q154R, and T166R mutations (TadA*8.10). In some embodiments, the ABE8 is ABE8.11-7, which has a heterodimeric construct containing TadA*7.10 fused to TadA*7.10 with Y147T and Q154R mutations (TadA*8.11). In some embodiments, the ABE8 is ABE8.12-7, which has a heterodimeric construct containing TadA*7.10 fused to TadA*7.10 with Y147T and Q154S mutations (TadA*8.12). In some embodiments, the ABE8 is ABE8.13-7, which has a heterodimeric construct containing TadA*7.10 fused to TadA*7.10 with Y123H (Y123H reverted from H123Y), Y147R, Q154R and I76Y mutations (TadA*8.13). In some embodiments, the ABE8 is ABE8.14-7, which has a heterodimeric construct containing TadA*7.10 fused to TadA*7.10 with 176Y and V82S mutations (TadA*8.14). In some embodiments, the ABE8 is ABE8.15-7, which has a heterodimeric construct containing TadA*7.10 fused to TadA*7.10 with V82S and Y147R mutations (TadA*8.15). In some embodiments, the ABE8 is ABE8.16-7, which has a heterodimeric construct containing TadA*7.10 fused to TadA*7.10 with V82S, Y123H (Y123H reverted from H123Y) and Y147R mutations (TadA*8.16). In some embodiments, the ABE8 is ABE8.17-7, which has a heterodimeric construct containing TadA*7.10 fused to TadA*7.10 with V82S and Q154R mutations (TadA*8.17). In some embodiments, the ABE8 is ABE8.18-7, which has a heterodimeric construct containing TadA*7.10 fused to TadA*7.10 with V82S, Y123H (Y123H reverted from H123Y) and Q154R mutations (TadA*8.18). In some embodiments, the ABE8 is ABE8.19-7, which has a heterodimeric construct containing TadA*7.10 fused to TadA*7.10 with V82S, Y123H (Y123H reverted from H123Y), Y147R and Q154R mutations (TadA*8.19). In some embodiments, the ABE8 is ABE8.20-7, which has a heterodimeric construct containing TadA*7.10 fused to TadA*7.10 with 176Y, V82S, Y123H (Y123H reverted from H123Y), Y147R and Q154R mutations (TadA*8.20). In some embodiments, the ABE8 is ABE8.21-7, which has a heterodimeric construct containing TadA*7.10 fused to TadA*7.10 with Y147R and Q154S mutations (TadA*8.21). In some embodiments, the ABE8 is ABE8.22-7, which has a heterodimeric construct containing TadA*7.10 fused to TadA*7.10 with V82S and Q154S mutations (TadA*8.22). In some embodiments, the ABE8 is ABE8.23-7, which has a heterodimeric construct containing TadA*7.10 fused to TadA*7.10 with V82S and Y123H (Y123H reverted from H123Y) mutations (TadA*8.23). In some embodiments, the ABE8 is ABE8.24-7, which has a heterodimeric construct containing TadA*7.10 fused to TadA*7.10 with V82S, Y123H (Y123H reverted from H123Y), and Y147T mutations (TadA*8.24).

[1] In some embodiments, the ABE is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m, ABE8.1-d, ABE8.2-d, ABE8.3-d, ABE8.4-d, ABE8.5-d, ABE8.6-d, ABE8.7-d, ABE8.8-d, ABE8.9-d, ABE8.10-d. ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d as shown in Table 12 below.

TABLE 12

Adenosine Base Editor 8 (ABE8) Variants

| ABE8 | Adenosine Deaminase | Adenosine Deaminase Description |
|---|---|---|
| ABE8.1-m | TadA*8.1 | Monomer_TadA*7.10 + Y147T |
| ABE8.2-m | TadA*8.2 | Monomer_TadA*7.10 + Y147R |
| ABE8.3-m | TadA*8.3 | Monomer_TadA*7.10 + Q154S |
| ABE8.4-m | TadA*8.4 | Monomer_TadA*7.10 + Y123H |
| ABE8.5-m | TadA*8.5 | Monomer_TadA*7.10 + V82S |
| ABE8.6-m | TadA*8.6 | Monomer_TadA*7.10 + T166R |
| ABE8.7-m | TadA*8.7 | Monomer_TadA*7.10 + Q154R |
| ABE8.8-m | TadA*8.8 | Monomer_TadA*7.10 + Y147R_Q154R_Y123H |
| ABE8.9-m | TadA*8.9 | Monomer_TadA*7.10 + Y147R_Q154R_I76Y |
| ABE8.10-m | TadA*8.10 | Monomer_TadA*7.10 + Y147R_Q154R_T166R |
| ABE8.11-m | TadA*8.11 | Monomer_TadA*7.10 + Y147T_Q154R |
| ABE8.12-m | TadA*8.12 | Monomer_TadA*7.10 + Y147T_Q154S |
| ABE8.13-m | TadA*8.13 | Monomer_TadA*7.10 + Y123H_Y147R_Q154R_I76Y |
| ABE8.14-m | TadA*8.14 | Monomer_TadA*7.10 + I76Y_V82S |
| ABE8.15-m | TadA*8.15 | Monomer_TadA*7.10 + V82S_Y147R |
| ABB8.16-m | TadA*8.16 | Monomer_TadA*7.10 + V82S_Y123H_Y147R |
| ABE8.17-m | TadA*8.17 | Monomer_TadA*7.10 + V82S_Q154R |
| ABE8.18-m | TadA*8.18 | Monomer_TadA*7.10 + V82S_Y123H_Q154R |
| ABE8.19-m | TadA*8.19 | Monomer_TadA*7.10 + V82S_Y123H_Y147R_Q154R |
| ABE8.20-m | TadA*8.20 | Monomer_TadA*7.10 + I76Y_V82S_Y123H_Y147R_Q154R |
| ABE8.21-m | TadA*8.21 | Monomer_TadA*7.10 + Y147R_Q154S |
| ABE8.22-m | TadA*8.22 | Monomer_TadA*7.10 + V82S_Q154S |
| ABE8.23-m | TadA*8.23 | Monomer_TadA*7.10 + V82S_Y123H |
| ABE8.24-m | TadA*8.24 | Monomer_TadA*7.10 + V82S_Y123H_Y147T |
| ABE8.1-d | TadA*8.1 | Heterodimer_(WT) + (TadA*7.10 + Y147T) |
| ABE8.2-d | TadA*8.2 | Heterodimer_(WT) + (TadA*7.10 + Y147R) |
| ABE8.3-d | TadA*8.3 | Heterodimer_(WT) + (TadA*7.10 + Q154S) |
| ABE8.4-d | TadA*8.4 | Heterodimer_(WT) + (TadA*7.10 + Y123H) |
| ABE8.5-d | TadA*8.5 | Heterodimer_(WT) + (TadA*7.10 + V82S) |
| ABE8.6-d | TadA*8.6 | Heterodimer_(WT) + (TadA*7.10 + T166R) |
| ABE8.7-d | TadA*8.7 | Heterodimer_(WT) + (TadA*7.10 + Q154R) |
| ABE8.8-d | TadA*8.8 | Heterodimer_(WT) + (TadA*7.10 + Y147R_Q154R_Y123H) |
| ABE8.9-d | TadA*8.9 | Heterodimer_(WT) + (TadA*7.10 + Y147R_Q154R_I76Y) |
| ABE8.10-d | TadA*8.10 | Heterodimer_(WT) + (TadA*7.10 + Y147R_Q154R_T166R) |
| ABE8.11-d | TadA*8.11 | Heterodimer_(WT) + (TadA*7.10 + Y147T_Q154R) |
| ABE8.12-d | TadA*8.12 | Heterodimer_(WT) + (TadA*7.10 + Y147T_Q154S) |
| ABE8.13-d | TadA*8.13 | Heterodimer_(WT) + (TadA*7.10 + Y123H_Y147T_Q154R_I76Y) |
| ABE8.14-d | TadA*8.14 | Heterodimer_(WT) + (TadA*7.10 + I76Y_V82S) |
| ABE8.15-d | TadA*8.15 | Heterodimer_(WT) + (TadA*7.10 + V82S_Y147R) |
| ABE8.16-d | TadA*8.16 | Heterodimer_(WT) + (TadA*7.10 + V82S_Y123H_Y147R) |
| ABE8.17-d | TadA*8.17 | Heterodimer_(WT) + (TadA*7.10 + V82S_Q154R) |
| ABE8.18-d | TadA*8.18 | Heterodimer_(WT) + (TadA*7.10 + V82S_Y123H_Q154R) |

TABLE 12-continued

| Adenosine Base Editor 8 (ABE8) Variants | | |
|---|---|---|
| ABE8 | Adenosine Deaminase | Adenosine Deaminase Description |
| ABE8.19-d | TadA*8.19 | Heterodimer_(WT) + (TadA*7.10 + V82S_Y123H_Y147R_Q154R) |
| ABE8.20-d | TadA*8.20 | Heterodimer_(WT) + (TadA*7.10 + I76Y_V82S_Y123H_Y147R_Q154R) |
| ABE8.21-d | TadA*8.21 | Heterodimer_(WT) + (TadA*7.10 + Y147R_Q154S) |
| ABE8.22-d | TadA*8.22 | Heterodimer_(WT) + (TadA*7.10 + V82S_Q154S) |
| ABE8.23-d | TadA*8.23 | Heterodimer_(WT) + (TadA*7.10 + V82S_Y123H) |
| ABE8.24-d | TadA*8.24 | Heterodimer_(WT) + (TadA*7.10 + V82S_Y123H_Y147T) |

In some embodiments, the ABE8 is ABE8a-m, which has a monomeric construct containing TadA*7.10 with R26C, A109S, T111R, D119N, H122N, Y147D, F149Y, T166I, and D167N mutations (TadA*8a). In some embodiments, the ABE8 is ABE8b-m, which has a monomeric construct containing TadA*7.10 with V88A, A109S, T111R, D119N, H122N, F149Y, T166I, and D167N mutations (TadA*8b). In some embodiments, the ABE8 is ABE8c-m, which has a monomeric construct containing TadA*7.10 with R26C, A109S, T111R, D119N, H122N, F149Y, T166I, and D167N mutations (TadA*8c). In some embodiments, the ABE8 is ABE8d-m, which has a monomeric construct containing TadA*7.10 with V88A, T111R, D119N, and F149Y mutations (TadA*8d). In some embodiments, the ABE8 is ABE8e-m, which has a monomeric construct containing TadA*7.10 with A109S, T111R, D119N, H122N, Y147D, F149Y, T166I, and D167N mutations (TadA*8e).

In some embodiments, the ABE8 is ABE8a-d, which has a heterodimeric construct containing wild-type *E. coli* TadA fused to TadA*7.10 with R26C, A109S, T111R, D119, H122N, Y147D, F149Y, T166I, and D167N mutations (TadA*8a). In some embodiments, the ABE8 is ABE8b-d, which has a heterodimeric construct containing wild-type *E. coli* TadA fused to TadA*7.10 with V88A, A109S, T111R, D119N, H122N, F149Y, T166I, and D167N mutations (TadA*8b). In some embodiments, the ABE8 is ABE8c-d, which has a heterodimeric construct containing wild-type *E. coli* TadA fused to TadA*7.10 with R26C, A109S, T111R, D119N, H122N, F149Y, T166I, and D167N mutations (TadA*8c). In some embodiments, the ABE8 is ABE8d-d, which has a heterodimeric construct containing wild-type *E. coli* TadA fused to TadA*7.10 with V88A, T111R, D119N, and F149Y mutations (TadA*8d). In some embodiments, the ABE8 is ABE8e-d, which has a heterodimeric construct containing wild-type *E. coli* TadA fused to TadA*7.10 with A109S, T111R, D119N, H122N, Y147D, F149Y, T166I, and D167N mutations (TadA*8e).

In some embodiments, the ABE8 is ABE8a-7, which has a heterodimeric construct containing TadA*7.10 fused to TadA*7.10 with R26C, A109S, T111R, D119, H122N, Y147D, F149Y, T166I, and D167N mutations (TadA*8a). In some embodiments, the ABE8 is ABE8b-7, which has a heterodimeric construct containing TadA*7.10 fused to TadA*7.10 with V88A, A109S, T111R, D119N, H122N, F149Y, T166I, and D167N mutations (TadA*8b). In some embodiments, the ABE8 is ABE8c-7, which has a heterodimeric construct containing TadA*7.10 fused to TadA*7.10 with R26C, A109S, T111R, D119N, H122N, F149Y, T166I, and D167N mutations (TadA*8c). In some embodiments, the ABE8 is ABE8d-7, which has a heterodimeric construct containing TadA*7.10 fused to TadA*7.10 with V88A, T111R, D119N, and F149Y mutations (TadA*8d). In some embodiments, the ABE8 is ABE8e-7, which has a heterodimeric construct containing TadA*7.10 fused to TadA*7.10 with A109S, T111R, D119N, H122N, Y147D, F149Y, T166I, and D167N mutations (TadA*8e).

In some embodiments, the ABE is ABE8a-m, ABE8b-m, ABE8c-m, ABE8d-m, ABE8e-m, ABE8a-d, ABE8b-d, ABE8c-d, ABE8d-d, or ABE8e-d, as shown in Table 13 below. In some embodiments, the ABE is ABE8e-m or ABE8e-d. ABE8e shows efficient adenine base editing activity and low indel formation when used with Cas homologues other than SpCas9, for example, SaCas9, SaCas9-KKH, Cas12a homologues, e.g., LbCas12a, enAs-Cas12a, SpCas9-NG and circularly permuted CP1028-SpCas9 and CP1041-SpCas9. In addition to the mutations shown for ABE8e in Table 13, off-target RNA and DNA editing were reduced by introducing a V106W substitution into the TadA domain (as described in M. Richter et al., 2020, Nature Biotechnology, doi.org/10.1038/s41587-020-0453-z, the entire contents of which are incorporated by reference herein).

TABLE 13

Additional Adenosine Base Editor 8 Variants. In the table, "monomer" indicates an ABE comprising a single TadA*7.10 comprising the indicated alterations and "heterodimer" indicates an ABE comprising a TadA*7.10 comprising the indicated alterations fused to an *E. coli* TadA adenosine deaminase.

| ABE8 Base Editor | Adenosine Deaminase | Adenosine Deaminase Description |
|---|---|---|
| ABE8a-m | TadA*8a | Monomer_TadA*7.10 + R26C + A109S + T111R + D119N + H122N + Y147D + F149Y + T166I + D167N |
| ABE8b-m | TadA*8b | Monomer_TadA*7.10 + V88A + A109S + T111R + D119N + H122N + F149Y + T166I + D167N |
| ABE8c-m | TadA*8c | Monomer_TadA*7.10 + R26C + A109S + T111R + D119N + H122N + F149Y + T166I + D167N |

TABLE 13-continued

Additional Adenosine Base Editor 8 Variants. In the table, "monomer" indicates an ABE comprising a single TadA*7.10 comprising the indicated alterations and "heterodimer" indicates an ABE comprising a TadA*7.10 comprising the indicated alterations fused to an *E. coli* TadA adenosine deaminase.

| ABE8 Base Editor | Adenosine Deaminase | Adenosine Deaminase Description |
|---|---|---|
| ABE8d-m | TadA*8d | Monomer_TadA*7.10 + V88A + T111R + D119N + F149Y |
| ABE8e-m | TadA*8e | Monomer_TadA*7.10 + A109S + T111R + D119N + H122N + Y147D + F149Y + T166I + D167N |
| ABE8a-d | TadA*8a | Heterodimer_(WT) + (TadA*7.10 + R26C + A109S + T111R + D119N + H122N + Y147D + F149Y + T166I + D167N) |
| ABE8b-d | TadA*8b | Heterodimer_(WT) + (TadA*7.10 + V88A + A109S + T111R + D119N + H122N + F149Y + T166I + D167N) |
| ABE8c-d | TadA*8c | Heterodimer_(WT) + (TadA*7.10 + R26C + A109S + T111R + D119N + H122N + F149Y + T166I + D167N) |
| ABE8d-d | TadA*8d | Heterodimer_(WT) + (TadA*7.10 + V88A + T111R + D119N + F149Y) |
| ABESe-d | TadA*8e | Heterodimer_(WT) + (TadA*7.10 + A109S + T111R + D119N + H122N + Y147D + F149Y + T166I + D167N) |

In some embodiments, base editors (e.g., ABE8) are generated by cloning an adenosine deaminase variant (e.g., TadA*8) into a scaffold that includes a circular permutant Cas9 (e.g., CP5 or CP6) and a bipartite nuclear localization sequence. In some embodiments, the base editor (e.g., ABE7.9, ABE7.10, or ABE8) is an NGC PAM CP5 variant (*S. pyogenes* Cas9 or spVRQR Cas9). In some embodiments, the base editor (e.g., ABE7.9, ABE7.10, or ABE8) is an AGA PAM CP5 variant (*S. pyogenes* Cas9 or spVRQR Cas9). In some embodiments, the base editor (e.g., ABE7.9, ABE7.10, or ABE8) is an NGC PAM CP6 variant (*S. pyogenes* Cas9 or spVRQR Cas9). In some embodiments, the base editor (e.g. ABE7.9, ABE7.10, or ABE8) is an AGA PAM CP6 variant (*S. pyogenes* Cas9 or spVRQR Cas9).

In some embodiments, the ABE has a genotype as shown in Table 14 below.

TABLE 14

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

As shown in Table 15 below, genotypes of 40 ABE8s are described. Residue positions in the evolved *E. coli* TadA portion of ABE are indicated. Mutational changes in ABE8 are shown when distinct from ABE7.10 mutations. In some embodiments, the ABE has a genotype of one of the ABEs as shown in Table 15 below.

TABLE 15

| Residue Identity in Evolved TadA | | | | | | | | | | | | | | | | | | |
|---|---|---|---|---|---|---|---|---|---|---|---|---|---|---|---|---|---|---|
| | 23 | 36 | 48 | 51 | 76 | 82 | 84 | 106 | 108 | 123 | 146 | 147 | 152 | 154 | 155 | 156 | 157 | 166 |
| ABE7.10 | R | L | A | L | I | V | F | V | N | Y | C | Y | P | Q | V | F | N | T |
| ABE8.1-m | | | | | | | | | | | | T | | | | | | |
| ABE8.2-m | | | | | | | | | | | | R | | | | | | |
| ABE8.3-m | | | | | | | | | | | | | | S | | | | |
| ABE8.4-m | | | | | | | | | | H | | | | | | | | |
| ABE8.5-m | | | | | | S | | | | | | | | | | | | |
| ABE8.6-m | | | | | | | | | | | | | | | | | | R |
| ABE8.7-m | | | | | | | | | | | | | | R | | | | |
| ABE8.8-m | | | | | | | | | | H | | R | | R | | | | |
| ABE8.9-m | | | | | Y | | | | | | | R | | R | | | | |
| ABE8.10-m | | | | | | | | | | | | R | | R | | | | R |
| ABE8.11-m | | | | | | | | | | | | T | | R | | | | |
| ABE8.12-m | | | | | | | | | | | | T | | S | | | | |
| ABE8.13-m | | | | | Y | | | | | H | | R | | R | | | | |
| ABE8.14-m | | | | | Y | S | | | | | | | | | | | | |
| ABE8.15-m | | | | | | S | | | | | | R | | | | | | |
| ABE8.16-m | | | | | | S | | | | H | | R | | | | | | |
| ABE8.17-m | | | | | | S | | | | | | | | R | | | | |
| ABE8.18-m | | | | | | S | | | | H | | | | R | | | | |
| ABE8.19-m | | | | | | S | | | | H | | R | | R | | | | |

TABLE 15-continued

| | Residue Identity in Evolved TadA | | | | | | | | | | | | | | | | | |
|---|---|---|---|---|---|---|---|---|---|---|---|---|---|---|---|---|---|---|
| | 23 | 36 | 48 | 51 | 76 | 82 | 84 | 106 | 108 | 123 | 146 | 147 | 152 | 154 | 155 | 156 | 157 | 166 |
| ABE8.20-m | | | | | Y | S | | | | H | | R | | R | | | | |
| ABE8.21-m | | | | | | | | | | | | R | | S | | | | |
| ABE8.22-m | | | | | | S | | | | | | | | S | | | | |
| ABE8.23-m | | | | | | S | | | | H | | | | | | | | |
| ABE8.24-m | | | | | | S | | | | H | | T | | | | | | |
| ABE8.1-d | | | | | | | | | | | | T | | | | | | |
| ABE8.2-d | | | | | | | | | | | | R | | | | | | |
| ABE8.3-d | | | | | | | | | | | | | | S | | | | |
| ABE8.4-d | | | | | | | | | | H | | | | | | | | |
| ABE8.5-d | | | | | | S | | | | | | | | | | | | |
| ABE8.6-d | | | | | | | | | | | | | | | | | | R |
| ABE8.7-d | | | | | | | | | | | | | | R | | | | |
| ABE8.8-d | | | | | | | | | | H | | R | | R | | | | |
| ABE8.9-d | | | | | Y | | | | | | | R | | R | | | | |
| ABE8.10-d | | | | | | | | | | | | R | | R | | | | R |
| ABE8.11-d | | | | | | | | | | | | T | | R | | | | |
| ABE8.12-d | | | | | | | | | | | | T | | S | | | | |
| ABE8.13-d | | | | | Y | | | | | H | | R | | R | | | | |
| ABE8.14-d | | | | | Y | S | | | | | | | | | | | | |
| ABE8.15-d | | | | | | S | | | | | | R | | | | | | |
| ABE8.16-d | | | | | | S | | | | H | | R | | | | | | |
| ABE8.17-d | | | | | | S | | | | | | | | R | | | | |
| ABE8.18-d | | | | | | S | | | | H | | | | R | | | | |
| ABE8.19-d | | | | | | S | | | | H | | R | | R | | | | |
| ABE8.20-d | | | | | Y | S | | | | H | | R | | R | | | | |
| ABE8.21-d | | | | | | | | | | | | R | | S | | | | |
| ABE8.22-d | | | | | | S | | | | | | | | S | | | | |
| ABE8.23-d | | | | | | S | | | | H | | | | | | | | |
| ABE8.24-d | | | | | | S | | | | H | | T | | | | | | |

In some embodiments, the base editor is ABE8.1, which comprises or consists essentially of the following sequence or a fragment thereof having adenosine deaminase activity:

ABE8.1 Y147T CP5 NGC PAM monomer (SEQ ID NO: 331)

MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRQVFNAQKKAQSSTD*SGGSSGGSSGSETPGTSES*

*ATPESSGGSSGGS*EIGKATAKYFFYSNIMNFFKTEITLANGEIRKRPLIEINGETGEIVWDK

GRDFATVRKVLSMPQVNIVKKTEVQTGGFSKESILPKRNSDKLIARKKDWDPKKYGGFMQPT

VAYSVLVVAKVEKGKSKKLKSVKELLGITIMERSSFEKNPIDFLEAKGYKEVKKDLIIKLPK

YSLFELENGRKRMLASAKFLQKGNELALPSKYVNFLYLASHYEKLKGSPEDNEQKQLFVEQH

KHYLDEIIEQISEFSKRVILADANLDKVLSAYNKHRDKPIREQAENIIHLFTLTNLGAPRAF

KYFDTTIARKEYRSTKEVLDATLIHQSITGLYETRIDLSQLGGD*GGSGGSGGSGGSGGSGGS*

*GG*MDKKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKL

FIQLVQTYNQLFEENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIER

MTNFDKNLPNEKVLPKHSLLYEYFTVYNELTKVKYVTEGMRKPAFLSGEQKKAIVDLLFKTN

-continued

RKVTVKQLKEDYFKKIECFDSVEISGVEDRFNASLGTYHDLLKIIKDKDFLDNEENEDILED

IVLTLTLFEDREMIEERLKTYAHLEDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVK

VVDELVKVMGRHKPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREINNYHHAHDAYLN

AVVGTALIKKYPKLESEFVYGDYKVYDVRKMIAKSEQEGADKRTADGSEFESPKKKRKV

In the above sequence, the plain text denotes an adenosine deaminase sequence, bold sequence indicates sequence derived from Cas9, the italicized sequence denotes a linker sequence, and the underlined sequence denotes a bipartite nuclear localization sequence. Other ABE8 sequences are provided in the attached sequence listing (SEQ ID NOs: 332-354).

In some embodiments, the base editor is a ninth generation ABE (ABE9). In some embodiments, the ABE9 contains a TadA*9 variant. ABE9 base editors include an adenosine deaminase variant comprising an amino acid sequence, which contains alterations relative to an ABE 7*10 reference sequence, as described herein. Exemplary ABE9 variants are listed in Table 16. Details of ABE9 base editors are described in International PCT Application No. PCT/2020/049975, which is incorporated herein by reference for its entirety.

TABLE 16

Adenosine Base Editor 9 (ABE9) Variants. In the table, "monomer" indicates an ABE comprising a single TadA*7.10 comprising the indicated alterations and "heterodimer" indicates an ABE comprising a TadA*7.10 comprising the indicated alterations fused to an *E. coli* TadA adenosine deaminase.

| ABE9 Description | Alterations |
|---|---|
| ABE9.1_monomer | E25F, V82S, Y123H, T133K, Y147R, Q154R |
| ABE9.2_monomer | E25F, V82S, Y123H, Y147R, Q154R |
| ABE9.3_monomer | V82S, Y123H, P124W, Y147R, Q154R |
| ABE9.4_monomer | L51W, V82S, Y123H, C146R, Y147R, Q154R |
| ABE9.5_monomer | P54C, V82S, Y123H, Y147R, Q154R |
| ABE9.6_monomer | Y73S, V82S, Y123H, Y147R, Q154R |
| ABE9.7_monomer | N38G, V82T, Y123H, Y147R, Q154R |
| ABE9.8_monomer | R23H, V82S, Y123H, Y147R, Q154R |
| ABE9.9_monomer | R21N, V82S, Y123H, Y147R, Q154R |
| ABE9.10_monomer | V82S, Y123H, Y147R, Q154R, A158K |
| ABE9.11_monomer | N72K, V82S, Y123H, D139L, Y147R, Q154R, |
| ABE9.12_monomer | E25F, V82S, Y123H, D139M, Y147R, Q154R |
| ABE9.13_monomer | M70V, V82S, M94V, Y123H, Y147R, Q154R |
| ABE9.14_monomer | Q71M, V82S, Y123H, Y147R, Q154R |
| ABE9.15_heterodimer | E25F, V82S, Y123H, T133K, Y147R, Q154R |
| ABE9.16_heterodimer | E25F, V82S, Y123H, Y147R, Q154R |
| ABE9.17_heterodimer | V82S, Y123H, P124W, Y147R, Q154R |
| ABE9.18_heterodimer | LS1W, V82S, Y123H, C146R, Y147R, Q154R |
| ABE9.19_heterodimer | P54C, V82S, Y123H, Y147R, Q154R |
| ABE9.2_heterodimer | Y73S, V82S, Y123H, Y147R, Q154R |
| ABE9.21_heterodimer | N38G, V82T, Y123H, Y147R, Q154R |
| ABE9.22_heterodimer | R23H, V82S, Y123H, Y147R, Q154R |
| ABE9.23_heterodimer | R21N, V82S, Y123H, Y147R, Q154R |
| ABE9.24_heterodimer | V82S, Y123H, Y147R, Q154R, A158K |
| ABE9.25_heterodimer | N72K, V82S, Y123H, D139L, Y147R, Q154R, |
| ABE9.26_heterodimer | E25F, V82S, Y123H, D139M, Y147R, Q154R |
| ABE9.27_heterodimer | M70V, V82S, M94V, Y123H, Y147R, Q154R |
| ABE9.28_heterodimer | Q71M, V82S, Y123H, Y147R, Q154R |
| ABE9.29_monomer | E25F_I76Y_V82S_Y123H_Y147R_Q154R |
| ABE9.30_monomer | I76Y_V82T_Y123H_Y147R_Q154R |
| ABE9.31_monomer | N38G_I76Y_V82S_Y123H_Y147R_Q154R |
| ABE9.32_monomer | N38G_I76Y_V82T_Y123H_Y147R_Q154R |
| ABE9.33_monomer | R23H_I76Y_V82S_Y123H_Y147R_Q154R |
| ABE9.34_monomer | P54C_I76Y_V82S_Y123H_Y147R_Q154R |
| ABE9.35_monomer | R21N_I76Y_V82S_Y123H_Y147R_Q154R |
| ABE9.36_monomer | I76Y_V82S_Y123H_D138M_Y147R_Q154R |
| ABE9.37_monomer | Y72S_I76Y_V82S_Y123H_Y147R_Q154R |
| ABE9.38_heterodimer | E25F_I76Y_V82S_Y123H_Y147R_Q154R |
| ABE9.39_heterodimer | I76Y_V82T_Y123H_Y147R_Q154R |
| ABE9.40_heterodimer | N38G_I76Y_V82S_Y123H_Y147R_Q154R |
| ABE9.41_heterodimer | N38G_I76Y_V82T_Y123H_Y147R_Q154R |
| ABE9.42_heterodimer | R23H_I76Y_V82S_Y123H_Y147R_Q154R |
| ABE9.43_heterodimer | P54C_I76Y_V82S_Y123H_Y147R_Q154R |
| ABE9.44_heterodimer | R21N_I76Y_V82S_Y123H_Y147R_Q154R |
| ABE9.45_heterodimer | I76Y_V82S_Y123H_D138M_Y147R_Q154R |
| ABE9.46_heterodimer | Y72S_I76Y_V82S_Y123H_Y147R_Q154R |
| ABE9.47_monomer | N72K_V82S, Y123H, Y147R, Q154R |
| ABE9.48_monomer | Q71M_V82S, Y123H, Y147R, Q154R |
| ABE9.49_monomer | M70V, V82S, M94V, Y123H, Y147R, Q154R |
| ABE9.50_monomer | V82S, Y123H, T133K, Y147R, Q154R |
| ABE9.51_monomer | V82S, Y123H, T133K, Y147R, Q154R, A158K |
| ABE9.52_monomer | M70V, Q71M, N72K, V82S, Y123H, Y147R, Q154R |
| ABE9.53_heterodimer | N72K_V82S, Y123H, Y147R, Q154R |
| ABE9.54_heterodimer | Q71M_V82S, Y123H, Y147R, Q154R |
| ABE9.55_heterodimer | M70V, V82S, M94V, Y123H, Y147R, Q154R |
| ABE9.56_heterodimer | V82S, Y123H, T133K, Y147R, Q154R |
| ABE9.57_heterodimer | V82S, Y123H, T133K, Y147R, Q154R, A158K |
| ABE9.58_heterodimer | M70V, Q71M, N72K, V82S, Y123H, Y147R, Q154R |

In some embodiments, the base editor comprises a domain comprising all or a portion of a uracil glycosylase inhibitor (UGI). In some embodiments, the base editor comprises a domain comprising all or a portion of a nucleic acid polymerase. In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some embodiments, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase). In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise a REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion) relative to a wild-type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g., adjacent domains) of the base editor disclosed herein can be connected to each other with or without the use of one or more linker domains (e.g., an XTEN linker domain). In some embodiments, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., an adenosine deaminase domain or a cytidine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., UGI, etc.).

Linkers

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated.

In some embodiments, any of the fusion proteins provided herein, comprise a cytidine or adenosine deaminase and a Cas9 domain that are fused to each other via a linker. Various linker lengths and flexibilities between the cytidine or adenosine deaminase and the Cas9 domain can be employed (e.g., ranging from very flexible linkers of the form (GGGS)n (SEQ ID NO: 246), (GGGGS)n (SEQ ID NO: 247), and (G)n to more rigid linkers of the form (EAAAK)n (SEQ ID NO: 248), (SGGS)n (SEQ ID NO: 355), SGSETPGTSESATPES (SEQ ID NO: 249) (see, e.g., Guilinger J P, et al. Fusion of catalytically inactive Cas9 to FokI nuclease improves the specificity of genome modification. Nat. Biotechnol. 2014; 32 (6): 577-82; the entire contents are incorporated herein by reference) and (XP)n) in order to achieve the optimal length for activity for the cytidine or adenosine deaminase nucleobase editor. In some embodiments, n is 1, 2, 3, 4, 5, 6, 7, 8, 9, 10, 11, 12, 13, 14, or 15. In some embodiments, the linker comprises a (GGS)n motif, wherein n is 1, 3, or 7. In some embodiments, cytidine deaminase or adenosine deaminase and the Cas9 domain of any of the fusion proteins provided herein are fused via a linker comprising the amino acid sequence SGSETPGTSESATPES (SEQ ID NO: 249), which can also be referred to as the XTEN linker.

In some embodiments, the domains of the base editor are fused via a linker that comprises the amino acid sequence of:

```
                                        (SEQ ID NO: 356)
SGGSSGSETPGTSESATPESSGGS,

                                        (SEQ ID NO: 357)
SGGSSGGSSGSETPGTSESATPESSGGSSGGS,
or

                                        (SEQ ID NO: 358)
GGSGGSPGSPAGSPTSTEEGTSESATPESGPGTSTEPSEGSAPGSPAGS
PTSTEEGTSTEPSEGSAPGTSTEPSEGSAPGTSESATPESGPGSEPATS
GGSGGS.
```

In some embodiments, domains of the base editor are fused via a linker comprising the amino acid sequence SGSETPGTSESATPES (SEQ ID NO: 249), which may also be referred to as the XTEN linker. In some embodiments, a linker comprises the amino acid sequence SGGS. In some embodiments, the linker is 24 amino acids in length. In some embodiments, the linker comprises the amino acid sequence SGGSSGGSSGSETPGTSESATPES (SEQ ID NO: 359). In some embodiments, the linker is 40 amino acids in length. In some embodiments, the linker comprises the amino acid sequence: SGGSSGGSSGSETPGTSESATPESSGGSSGGSSGGSSGGS (SEQ ID NO: 360). In some embodiments, the linker is 64 amino acids in length. In some embodiments, the linker comprises the amino acid sequence: SGGSSGGSSGSETPGTSESATPESSGGSSGGSSGGSSGGSSGSETPGTSESATPESSGGS SGGS (SEQ ID NO: 361). In some embodiments, the linker is 92 amino acids in length. In some embodiments, the linker comprises the amino acid sequence:

```
                                        (SEQ ID NO: 362)
PGSPAGSPTSTEEGTSESATPESGPGTSTEPSEGSAPGSPAGSPTSTEE
GTSTEPSEGSAPGTSTEPSEGSAPGTSESATPESGPGSEPATS.
```

In some embodiments, a linker comprises a plurality of proline residues and is 5-21, 5-14, 5-9, 5-7 amino acids in length, e.g., PAPAP (SEQ ID NO: 363), PAPAPA (SEQ ID NO: 364), PAPAPAP (SEQ ID NO: 365), PAPAPAPA (SEQ ID NO: 366), P(AP)4 (SEQ ID NO: 367), P(AP)7 (SEQ ID NO: 368), P(AP)10 (SEQ ID NO: 369) (see, e.g., Tan J, Zhang F, Karcher D, Bock R. Engineering of high-precision base editors for site-specific single nucleotide replacement. Nat Commun 2019 Jan. 25; 10 (1): 439; the entire contents are incorporated herein by reference). Such proline-rich linkers are also termed "rigid" linkers.

In another embodiment, the base editor system comprises a component (protein) that interacts non-covalently with a deaminase (DNA deaminase), e.g., an adenosine or a cytidine deaminase, and transiently attracts the adenosine or cytidine deaminase to the target nucleobase in a target polynucleotide sequence for specific editing, with minimal or reduced bystander or target-adjacent effects. Such a non-covalent system and method involving deaminase-interacting proteins serves to attract a DNA deaminase to a particular genomic target nucleobase and decouples the events of on-target and target-adjacent editing, thus enhancing the achievement of more precise single base substitution mutations. In an embodiment, the deaminase-interacting protein binds to the deaminase (e.g., adenosine deaminase or cytidine deaminase) without blocking or interfering with the active (catalytic) site of the deaminase from engaging the target nucleobase (e.g., adenosine or cytidine, respectively). Such as system, termed "MagnEdit," involves interacting proteins tethered to a Cas9 and gRNA complex and can attract a co-expressed adenosine or cytidine deaminase (either exogenous or endogenous) to edit a specific genomic target site, and is described in McCann, J. et al., 2020, "MagnEdit—interacting factors that recruit DNA-editing enzymes to single base targets," Life-Science-Alliance, Vol. 3, No. 4 (e201900606), (doi 10.26508/lsa. 201900606), the contents of which are incorporated by reference herein in their entirety. In an embodiment, the DNA deaminase is an adenosine deaminase variant (e.g., TadA*8) as described herein.

In another embodiment, a system called "Suntag," involves non-covalently interacting components used for recruiting protein (e.g., adenosine deaminase or cytidine deaminase) components, or multiple copies thereof, of base editors to polynucleotide target sites to achieve base editing at the site with reduced adjacent target editing, for example, as described in Tanenbaum, M. E. et al., "A protein tagging system for signal amplification in gene expression and fluorescence imaging," Cell. 2014 Oct. 23; 159 (3): 635-646. doi: 10.1016/j.cell.2014.09.039; and in Huang, Y.-H. et al., 2017, "DNA epigenome editing using CRISPR-Cas SunTag-directed DNMT3A," Genome Biol 18:176. doi:10.1186/s13059-017-1306-z, the contents of each of which are incorporated by reference herein in their entirety. In an embodiment, the DNA deaminase is an adenosine deaminase variant (e.g., TadA*8) as described herein.

Nucleic Acid Programmable DNA Binding Proteins with Guide RNAs

Provided herein are compositions and methods for base editing in cells. Further provided herein are compositions comprising a guide polynucleic acid sequence, e.g. a guide RNA sequence, or a combination of 2, 3, 4, 5, 6, 7, 8, 9, 10, 11, 12, 13, 14, 15, 16, 17, 18, 19, 20, or more guide RNAs as provided herein. In some embodiments, a composition for base editing as provided herein further comprises a polynucleotide that encodes a base editor, e.g. a C-base editor or an A-base editor. For example, a composition for base editing may comprise a mRNA sequence encoding a BE, a BE4, an ABE, and a combination of one or more guide RNAs as provided. A composition for base editing may comprise a base editor polypeptide and a combination of one or more of any guide RNAs provided herein. Such a composition may be used to effect base editing in a cell through different delivery approaches, for example, electroporation, nucleofection, viral transduction or transfection. In some embodiments, the composition for base editing comprises an mRNA sequence that encodes a base editor and a combination of one or more guide RNA sequences provided herein for electroporation.

Some aspects of this disclosure provide complexes comprising any of the fusion proteins provided herein, and a guide RNA bound to a nucleic acid programmable DNA binding protein (napDNAbp) domain (e.g., a Cas9 (e.g., a dCas9, a nuclease active Cas9, or a Cas9 nickase) or Cas12) of the fusion protein. These complexes are also termed ribonucleoproteins (RNPs). In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 7 or S'-NAA-3'). In some embodiments, the guide nucleic acid (e.g., guide RNA) is complementary to a sequence in a gene of interest (e.g., a gene associated with a disease or disorder).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or S' (TTTV) sequence. In some embodiments, the 3' end of the target sequence is immediately adjacent to an e.g., TTN, DTTN, GTTN, ATTN, ATTC, DTTNT, WTTN, HATY, TTTN, TTTV, TTTC, TG, RTR, or YTN PAM site.

It will be understood that the numbering of the specific positions or residues in the respective sequences depends on the particular protein and numbering scheme used. Numbering might differ, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for napDNAbp (e.g., Cas9 or Cas12) binding, and a guide sequence, which confers sequence specificity to the napDNAbp:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting napDNAbp:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Distinct portions of sgRNA are predicted to form various features that interact with Cas9 (e.g., SpyCas9) and/or the DNA target. Six conserved modules have been identified within native crRNA:tracrRNA duplexes and single guide RNAs (sgRNAs) that direct Cas9 endonuclease activity (see Briner et al., Guide RNA Functional Modules Direct Cas9 Activity and Orthogonality Mol Cell. 2014 Oct. 23; 56 (2): 333-339). The six modules include the spacer responsible for DNA targeting, the upper stem, bulge, lower stem formed by the CRISPR repeat:tracrRNA duplex, the nexus, and hairpins from the 3' end of the tracrRNA. The upper and lower stems interact with Cas9 mainly through sequence-independent interactions with the phosphate backbone. In some embodiments, the upper stem is dispensable. In some embodiments, the conserved uracil nucleotide sequence at the base of the lower stem is dispensable. The bulge participates in specific side-chain interactions with the Rec1 domain of Cas9. The nucleobase of U44 interacts with the side chains of Tyr 325 and His 328, while G43 interacts with Tyr 329. The nexus forms the core of the sgRNA: Cas9 interactions and lies at the intersection between the sgRNA and both Cas9 and the target DNA. The nucleobases of A51 and A52 interact with the side chain of Phe 1105; U56 interacts with Arg 457 and Asn 459; the nucleobase of U59 inserts into a hydrophobic pocket defined by side chains of Arg 74, Asn 77, Pro 475, Leu 455, Phe 446, and Ile 448; C60 interacts with Leu 455, Ala 456, and Asn 459, and C61 interacts with the side chain of Arg 70, which in turn interacts with C15. In some embodiments, one or more of these mutations are made in the bulge and/or the nexus of a sgRNA for a Cas9 (e.g., spyCas9) to optimize sgRNA: Cas9 interactions.

Moreover, the tracrRNA nexus and hairpins are critical for Cas9 pairing and can be swapped to cross orthogonality barriers separating disparate Cas9 proteins, which is instrumental for further harnessing of orthogonal Cas9 proteins. In some embodiments, the nexus and hairpins are swapped to target orthogonal Cas9 proteins. In some embodiments, a sgRNA is dispensed of the upper stem, hairpin 1, and/or the sequence flexibility of the lower stem to design a guide RNA that is more compact and conformationally stable. In some embodiments, the modules are modified to optimize multiplex editing using a single Cas9 with various chimeric guides or by concurrently using orthogonal systems with different combinations of chimeric sgRNAs. Details regarding guide functional modules and methods thereof are described, for example, in Briner et al., Guide RNA Functional Modules Direct Cas9 Activity and Orthogonality Mol Cell. 2014 Oct. 23; 56 (2): 333-339, the contents of which is incorporated by reference herein in its entirety.

The domains of the base editor disclosed herein can be arranged in any order. Non-limiting examples of a base editor comprising a fusion protein comprising e.g., a polynucleotide-programmable nucleotide-binding domain (e.g., Cas9 or Cas12) and a deaminase domain (e.g., cytidine or adenosine deaminase) can be arranged as follows:

NH2-[nucleobase editing domain]-Linker1-[nucleobase editing domain]-COOH;

NH2-[deaminase]-Linker1-[nucleobase editing domain]-COOH;

NH2-[deaminase]-Linker1-[nucleobase editing domain]-Linker2-[UGI]—COOH;

NH2-[deaminase]-Linker1-[nucleobase editing domain]-COOH;

NH2-[adenosine deaminase]-Linker1-[nucleobase editing domain]-COOH;

NH2-[nucleobase editing domain]-[deaminase]-COOH;

NH2-[deaminase]-[nucleobase editing domain]-[inosine BER inhibitor]-COOH;

NH2-[deaminase]-[inosine BER inhibitor]-[nucleobase editing domain]-COOH;

NH2-[inosine BER inhibitor]-[deaminase]-[nucleobase editing domain]-COOH;

NH2-[nucleobase editing domain]-[deaminase]-[inosine BER inhibitor]-COOH,

NH2-[nucleobase editing domain]-[inosine BER inhibitor]-[deaminase]-COOH;

NH2-[inosine BER inhibitor]-[nucleobase editing domain]-[deaminase]-COOH;

NH2-[nucleobase editing domain]-Linker1-[deaminase]-Linker2-[nucleobase editing domain]-COOH;

NH2-[nucleobase editing domain]-Linker1-[deaminase]-[nucleobase editing domain]-COOH;

NH2-[nucleobase editing domain]-[deaminase]-Linker2-[nucleobase editing domain]-COOH;

NH2-[nucleobase editing domain]-[deaminase]-[nucleobase editing domain]-COOH;

NH2-[nucleobase editing domain]-Linker1-[deaminase]-Linker2-[nucleobase editing domain]-[inosine BER inhibitor]-COOH;

NH2-[nucleobase editing domain]-Linker1-[deaminase]-[nucleobase editing domain]-[inosine BER inhibitor]-COOH;

NH2-[nucleobase editing domain]-[deaminase]-Linker2-[nucleobase editing domain]-[inosine BER inhibitor]-COOH;

NH2-[nucleobase editing domain]-[deaminase]-[nucleobase editing domain]-[inosine BER inhibitor]-COOH, NH2-[inosine BER inhibitor]-[nucleobase editing domain]-Linker1-[deaminase]-Linker2-[nucleobase editing domain]-COOH;

NH2-[inosine BER inhibitor]-[nucleobase editing domain]-Linker1-[deaminase]-[nucleobase editing domain]-COOH;

NH2-[inosine BER inhibitor]-[nucleobase editing domain]-[deaminase]-Linker2-[nucleobase editing domain]-COOH; or NH2-[inosine BER inhibitor] NH2-[nucleobase editing domain]-[deaminase]-[nucleobase editing domain]-COOH.

In some embodiments, the base editing fusion proteins provided herein need to be positioned at a precise location, for example, where a target base is placed within a defined region (e.g., a "deamination window"). In some embodiments, a target can be within a 4-base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a napDNAbp domain. In some embodiments, an NLS of the base editor is localized C-terminal to a napDNAbp domain.

Non-limiting examples of protein domains which can be included in the fusion protein include a deaminase domain (e.g., adenosine deaminase or cytidine deaminase), a uracil glycosylase inhibitor (UGI) domain, epitope tags, reporter gene sequences, and/or protein domains having one or more of the activities described herein.

A domain may be detected or labeled with an epitope tag, a reporter protein, other binding domains. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions.

Methods of Using Fusion Proteins Comprising a Cytidine or Adenosine Deaminase and a Cas9 Domain Some aspects of this disclosure provide methods of using the fusion proteins, or complexes provided herein. For example, some aspects of this disclosure provide methods comprising contacting a DNA molecule with any of the fusion proteins provided herein, and with at least one guide RNA described herein.

In some embodiments, a fusion protein of the invention is used for editing a target gene of interest. In particular, a cytidine deaminase or adenosine deaminase nucleobase editor described herein is capable of making multiple mutations within a target sequence. These mutations may affect the function of the target. For example, when a cytidine deaminase or adenosine deaminase nucleobase editor is used to target a regulatory region the function of the regulatory region is altered and the expression of the downstream protein is reduced or eliminated.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and a cytidine or adenosine deaminase, as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

In some embodiments, the purpose of the methods provided herein is to alter a gene and/or gene product via gene editing. The nucleobase editing proteins provided herein can be used for gene editing-based human therapeutics in vitro or in vivo. It will be understood by the skilled artisan that the nucleobase editing proteins provided herein, e.g., the fusion proteins comprising a polynucleotide programmable nucleotide binding domain (e.g., Cas9) and a nucleobase editing domain (e.g., an adenosine deaminase domain or a cytidine deaminase domain) can be used to edit a nucleotide from A to G or C to T.

Advantageously, base editing systems as provided herein provide genome editing without generating double-strand DNA breaks, without requiring a donor DNA template, and without inducing an excess of stochastic insertions and deletions as CRISPR may do. In some embodiments, the present disclosure provides base editors that efficiently generate an intended mutation, such as a STOP codon, in a nucleic acid (e.g., a nucleic acid within a genome of a subject) without generating a significant number of unintended mutations, such as unintended point mutations. In some embodiments, an intended mutation is a mutation that is generated by a specific base editor (e.g., adenosine base editor or cytidine base editor) bound to a guide polynucleotide (e.g., gRNA), specifically designed to generate the intended mutation. In some embodiments, the intended mutation is in a gene associated with a target antigen associated with a disease or disorder, e.g., T- or NK-cell malignancy. In some embodiments, the intended mutation is an adenine (A) to guanine (G) point mutation (e.g., SNP) in a gene associated with a target antigen associated with a disease or disorder, e.g T- or NK-cell malignancy. In some embodiments, the intended mutation is an adenine (A) to guanine (G) point mutation within the coding region or non-coding region of a gene (e.g., regulatory region or element). In some embodiments, the intended mutation is a cytosine (C) to thymine (T) point mutation (e.g., SNP) in a gene associated with a target antigen associated with a disease or disorder, e.g., T- or NK-cell malignancy. In some embodiments, the intended mutation is a cytosine (C) to thymine (T) point mutation within the coding region or non-coding region of a gene (e.g., regulatory region or element). In some embodiments, the intended mutation is a point mutation that generates a STOP codon, for example, a premature STOP codon within the coding region of a gene. In some embodiments, the intended mutation is a mutation that eliminates a stop codon.

The base editors of the invention advantageously modify a specific nucleotide base encoding a protein without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In some embodiments, it is desirable to generate base editors that efficiently modify (e.g. mutate or methylate) a specific nucleotide within a nucleic acid, without generating a large number of insertions or deletions (i.e., indels) in the nucleic acid. In certain embodiments, any of the base editors provided herein can generate a greater proportion of intended modifications (e.g., methylations) versus indels. In certain embodiments, any of the base editors provided herein can generate a greater proportion of intended modifications (e.g., mutations) versus indels.

In some embodiments, the base editors provided herein are capable of generating a ratio of intended mutations to indels (i.e., intended point mutations:unintended point mutations) that is greater than 1:1. In some embodiments, the base editors provided herein are capable of generating a ratio of intended mutations to indels that is at least 1.5.1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method.

In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein can limit the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, a number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a considerable number of unintended mutations (e.g., spurious off-target editing or bystander editing). In some embodiments, an intended mutation is a mutation that is generated by a specific base editor bound to a gRNA, specifically designed to generate the intended mutation. In some embodiments, the intended mutation is a mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended mutations:unintended mutations) that is greater than 1:1. In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10.1, at least 12:1, at least 15:1, at least 20.1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described herein may be applied to any of the fusion proteins, or methods of using the fusion proteins provided herein.

Base editing is often referred to as a "modification", such as, a genetic modification, a gene modification and modification of the nucleic acid sequence and is clearly understandable based on the context that the modification is a base editing modification. A base editing modification is therefore a modification at the nucleotide base level, for example as a result of the deaminase activity discussed throughout the disclosure, which then results in a change in the gene sequence, and may affect the gene product. In essence therefore, the gene editing modification described herein may result in a modification of the gene, structurally and/or functionally, wherein the expression of the gene product may be modified, for example, the expression of the gene is knocked out; or conversely, enhanced, or, in some circumstances, the gene function or activity may be modified. Using the methods disclosed herein, a base editing efficiency may be determined as the knockdown efficiency of the gene in which the base editing is performed, wherein the base editing is intended to knockdown the expression of the gene. A knockdown level may be validated quantitatively by determining the expression level by any detection assay, such as assay for protein expression level, for example, by flow cytometry; assay for detecting RNA expression such as quantitative RT-PCR, northern blot analysis, or any other suitable assay such as pyrosequencing; and may be validated qualitatively by nucleotide sequencing reactions.

In some embodiments, the modification, e.g., single base edit results in at least 10% reduction of the gene targeted expression. In some embodiments, the base editing efficiency may result in at least 10% reduction of the gene targeted expression. In some embodiments, the base editing efficiency may result in at least 20% reduction of the gene targeted expression. In some embodiments, the base editing efficiency may result in at least 30% reduction of the gene targeted expression. In some embodiments, the base editing efficiency may result in at least 40% reduction of the gene targeted expression. In some embodiments, the base editing efficiency may result in at least 50% reduction of the gene targeted expression. In some embodiments, the base editing efficiency may result in at least 60% reduction of the targeted gene expression. In some embodiments, the base editing efficiency may result in at least 70% reduction of the targeted gene expression. In some embodiments, the base editing efficiency may result in at least 80% reduction of the targeted gene expression. In some embodiments, the base editing efficiency may result in at least 90% reduction of the targeted gene expression. In some embodiments, the base editing efficiency may result in at least 91% reduction of the targeted gene expression. In some embodiments, the base editing efficiency may result in at least 92% reduction of the targeted gene expression. In some embodiments, the base editing efficiency may result in at least 93% reduction of the targeted gene expression. In some embodiments, the base editing efficiency may result in at least 94% reduction of the targeted gene expression. In some embodiments, the base editing efficiency may result in at least 95% reduction of the targeted gene expression. In some embodiments, the base editing efficiency may result in at least 96% reduction of the targeted gene expression. In some embodiments, the base editing efficiency may result in at least 97% reduction of the targeted gene expression. In some embodiments, the base editing efficiency may result in at least 98% reduction of the targeted gene expression. In some embodiments, the base editing efficiency may result in at least 99% reduction of the targeted gene expression. In some embodiments, the base editing efficiency may result in knockout (100% knockdown of the gene expression) of the gene that is targeted.

In some embodiments, any of the base editor systems provided herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

In some embodiments, targeted modifications, e.g., single base editing, are used simultaneously to target at least 4, 5, 6, 7, 8, 9, 10, 11, 12 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 different endogenous sequences for base editing with different guide RNAs. In some embodiments, targeted modifications, e.g. single base editing, are used to sequentially target at least 4, 5, 6, 7, 8, 9, 10, 11, 12 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 50, or more different endogenous gene sequences for base editing with different guide RNAs.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations, such as unintended point mutations (i.e., mutation of bystanders). In some embodiments, any of the base editors provided herein are capable of generating at least 0.01% of intended mutations (i.e., at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, any of the base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence. In some embodiments, any of the base editor systems comprising one of the ABE8 base editor variants described herein result in less than 0.8% indel formation in the target polynucleotide sequence. In some embodiments, any of the base editor systems comprising one of the ABE8 base editor variants described herein result in at most 0.8% indel formation in the target polynucleotide sequence. In some embodiments, any of the base editor systems comprising one of the ABE8 base editor variants described herein result in less than 0.3% indel formation in the target polynucleotide sequence. In some embodiments, any of the base editor systems comprising one of the ABE8 base editor variants described results in lower indel formation in the target polynucleotide sequence compared to a base editor system comprising one of ABE7 base editors. In some embodiments, any of the base editor systems comprising one of the ABE8 base editor variants described herein results in lower indel formation in the target polynucleotide sequence compared to a base editor system comprising an ABE7.10.

In some embodiments, any of the base editor systems comprising one of the ABE8 base editor variants described herein has reduction in indel frequency compared to a base editor system comprising one of the ABE7 base editors. In some embodiments, any of the base editor systems comprising one of the ABE8 base editor variants described herein has at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction in indel frequency compared to a base editor system comprising one of the ABE7 base editors. In some embodiments, a base editor system comprising one of the ABE8 base editor variants described herein has at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction in indel frequency compared to a base editor system comprising an ABE7.10.

The invention provides adenosine deaminase variants (e.g., ABE8 variants) that have increased efficiency and specificity. In particular, the adenosine deaminase variants described herein are more likely to edit a desired base within a polynucleotide, and are less likely to edit bases that are not intended to be altered (e.g., "bystanders").

In some embodiments, any of the base editing system comprising one of the ABE8 base editor variants described herein has reduced bystander editing or mutations. In some embodiments, an unintended editing or mutation is a bystander mutation or bystander editing, for example, base editing of a target base (e.g., A or C) in an unintended or non-target position in a target window of a target nucleotide sequence. In some embodiments, any of the base editing system comprising one of the ABE8 base editor variants described herein has reduced bystander editing or mutations compared to a base editor system comprising an ABE7 base editor, e.g., ABE7.10. In some embodiments, any of the base editing system comprising one of the ABE8 base editor variants described herein has reduced bystander editing or mutations by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% compared to a base editor system comprising an ABE7 base editor, e.g., ABE7.10. In some embodiments, any of the base editing system comprising one of the ABE8 base editor variants described herein has reduced bystander editing or mutations by at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

In some embodiments, any of the base editing system comprising one of the ABE8 base editor variants described herein has reduced spurious editing. In some embodiments, an unintended editing or mutation is a spurious mutation or spurious editing, for example, non-specific editing or guide independent editing of a target base (e.g., A or C) in an unintended or non-target region of the genome. In some embodiments, any of the base editing system comprising one of the ABE8 base editor variants described herein has reduced spurious editing compared to a base editor system comprising an ABE7 base editor, e.g., ABE7.10. In some embodiments, any of the base editing system comprising one of the ABE8 base editor variants described herein has reduced spurious editing by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% compared to a base editor system comprising an ABE7 base editor, e.g., ABE7.10. In some embodiments, any of the base editing system comprising one of the ABE8 base editor variants described herein has reduced spurious editing by at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% base editing efficiency. In some embodiments, the base editing efficiency may be measured by calculating the percentage of edited nucleobases in a population of cells. In some embodiments, any of the ABE8 base editor variants described herein have base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases in a population of cells.

In some embodiments, any of the ABE8 base editor variants described herein has higher base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher base editing efficiency compared to an ABE7 base editor, e.g., ABE7.10.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% on-target base editing efficiency. In some embodiments, any of the ABE8 base editor variants described herein have on-target base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited target nucleobases in a population of cells.

In some embodiments, any of the ABE8 base editor variants described herein has higher on-target base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher on-target base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target base editing efficiency compared to an ABE7 base editor, e.g., ABE7.10.

The ABE8 base editor variants described herein may be delivered to a host cell via a plasmid, a vector, a LNP complex, or an mRNA. In some embodiments, any of the ABE8 base editor variants described herein is delivered to a host cell as an mRNA. In some embodiments, an ABE8 base editor delivered via a nucleic acid based delivery system, e.g., an mRNA, has on-target editing efficiency of at least at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases. In some embodiments, an ABE8 base editor delivered by an mRNA system has higher base editing efficiency compared to an ABE8 base editor delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% on-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target editing efficiency when delivered by an mRNA system compared to when delivered by a plasmid or vector system.

In some embodiments, any of the base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% off-target editing in the target polynucleotide sequence.

In some embodiments, any of the ABE8 base editor variants described herein has lower guided off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guided off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold lower guided off-target editing efficiency when delivered by an mRNA system compared to when delivered by a plasmid or vector system. In some embodiments, any of the ABE8 base editor variants described herein has at least about 2.2 fold decrease in guided off-target editing efficiency when delivered by an mRNA system compared to when delivered by a plasmid or vector system.

In some embodiments, any of the ABE8 base editor variants described herein has lower guide-independent off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guide-independent off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 5.0 fold, at least 10.0 fold, at least 20.0 fold, at least 50.0 fold, at least 70.0 fold, at least 100.0 fold, at least 120.0 fold, at least 130.0 fold, or at least 150.0 fold lower guide-independent off-target editing efficiency when delivered by an mRNA system compared to when delivered by a plasmid or vector system. In some embodiments, ABE8 base editor variants described herein has 134.0 fold decrease in guide-independent off-target editing efficiency (e.g., spurious RNA deamination) when delivered by an mRNA system compared to when delivered by a plasmid or vector system. In some embodiments, ABE8 base editor variants described herein does not increase guide-independent mutation rates across the genome.

In some embodiments, a single gene delivery event (e.g., by transduction, transfection, electroporation or any other method) can be used to target base editing of 5 sequences within a cell's genome. In some embodiments, a single gene delivery event can be used to target base editing of 6 sequences within a cell's genome. In some embodiments, a single gene delivery event can be used to target base editing of 7 sequences within a cell's genome. In some embodiments, a single electroporation event can be used to target base editing of 8 sequences within a cell's genome. In some embodiments, a single gene delivery event can be used to target base editing of 9 sequences within a cell's genome. In some embodiments, a single gene delivery event can be used to target base editing of 10 sequences within a cell's genome. In some embodiments, a single gene delivery event can be used to target base editing of 20 sequences within a cell's genome. In some embodiments, a single gene delivery event can be used to target base editing of 30 sequences within a cell's genome. In some embodiments, a single gene delivery event can be used to target base editing of 40 sequences within a cell's genome. In some embodiments, a single gene delivery event can be used to target base editing of 50 sequences within a cell's genome.

In some embodiments, the method described herein, for example, the base editing methods has minimum to no off-target effects.

In some embodiments, the base editing method described herein results in at least 50% of a cell population that have been successfully edited (i.e., cells that have been successfully engineered) In some embodiments, the base editing method described herein results in at least 55% of a cell population that have been successfully edited. In some embodiments, the base editing method described herein results in at least 60% of a cell population that have been successfully edited. In some embodiments, the base editing method described herein results in at least 65% of a cell population that have been successfully edited. In some embodiments, the base editing method described herein results in at least 70% of a cell population that have been successfully edited. In some embodiments, the base editing method described herein results in at least 75% of a cell population that have been successfully edited. In some embodiments, the base editing method described herein results in at least 80% of a cell population that have been successfully edited. In some embodiments, the base editing method described herein results in at least 85% of a cell population that have been successfully edited. In some embodiments, the base editing method described herein results in at least 90% of a cell population that have been successfully edited. In some embodiments, the base editing method described herein results in at least 95% of a cell population that have been successfully edited. In some embodiments, the base editing method described herein results in about 91%, 92%, 93%, 94%, 95%, 96%, 97%, 98%, 99% or 100% of a cell population that have been successfully edited.

In some embodiments, the live cell recovery following a base editing intervention is greater than at least 60%, 70%, 80%, 90% of the starting cell population at the time of the base editing event. In some embodiments, the live cell recovery as described above is about 70%. In some embodiments, the live cell recovery as described above is about 75%. In some embodiments, the live cell recovery as described above is about 80%. In some embodiments, the live cell recovery as described above is about 85%. In some embodiments, the live cell recovery as described above is about 90%, or about 91%, 92%, 93%, 94% 95%, 96%, 97%, 98%, or 99%, or 100% of the cells in the population at the time of the base editing event.

In some embodiments the engineered cell population can be further expanded in vitro by about 2 fold, about 3-fold, about 4-fold, about 5-fold, about 6-fold, about 7-fold, about 8-fold, about 9-fold, about 10-fold, about 15-fold, about 20-fold, about 25-fold, about 30-fold, about 35-fold, about 40-fold, about 45-fold, about 50-fold, or about 100-fold.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

Details of base editor efficiency are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference. In some embodiments, editing of a plurality of nucleobase pairs in one or more genes using the methods provided herein results in formation of at least one intended mutation. In some embodiments, said formation of said at least one intended mutation results in the disruption the normal function of a gene. In some embodiments, said formation of said at least one intended mutation results decreases or eliminates the expression of a protein encoded by a gene. It should be appreciated that multiplex editing can be accomplished using any method or combination of methods provided herein.

Multiplex Editing

In some embodiments, the base editor system provided herein is capable of multiplex editing of a plurality of nucleobase pairs in one or more genes or polynucleotide sequences. In some embodiments, the plurality of nucleobase pairs is located in the same gene or in one or more genes, wherein at least one gene is located in a different locus. In some embodiments, the multiplex editing can comprise one or more guide polynucleotides. In some embodiments, the multiplex editing can comprise one or more base editor systems. In some embodiments, the multiplex editing can comprise one or more base editor systems with a single guide polynucleotide or a plurality of guide polynucleotides. In some embodiments, the multiplex editing can comprise one or more guide polynucleotides with a single base editor system. In some embodiments, the multiplex editing can comprise at least one guide polynucleotide that does or does not require a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any combination of methods using any base editor provided herein. It should also be appreciated that the multiplex editing using any of the base editors as described herein can comprise a sequential editing of a plurality of nucleobase pairs.

In some embodiments, the plurality of nucleobase pairs are in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region, in at least one protein non-coding region, or in at least one protein coding region and at least one protein non-coding region.

In some embodiments, the editing is in conjunction with one or more guide polynucleotides. In some embodiments, the base editor system can comprise one or more base editor systems. In some embodiments, the base editor system can comprise one or more base editor systems in conjunction with a single guide polynucleotide or a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence or with at least one guide polynucleotide that requires a PAM sequence to target binding to a target polynucleotide sequence, or with a mix of at least one guide polynucleotide that does not require a PAM sequence to target binding to a target polynucleotide sequence and at least one guide polynucleotide that does require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

In some embodiments, the base editor system capable of multiplex editing of a plurality of nucleobase pairs in one or more genes comprises one of ABE7, ABE8, and/or ABE9 base editors. In some embodiments, the base editor system capable of multiplex editing comprising one of the ABE8 base editor variants described herein has higher multiplex editing efficiency compared to the base editor system capable of multiplex editing comprising one of ABE7 base editors. In some embodiments, the base editor system capable of multiplex editing comprising one of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% higher multiplex editing efficiency compared the base editor system capable of multiplex editing comprising one of ABE7 base editors. In some embodiments, the base editor system capable of multiplex editing comprising one of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 4.0 fold, at least 4.5 fold, at least 5.0 fold, at least 5.5 fold, or at least 6.0 fold higher multiplex editing efficiency compared the base editor system capable of multiplex editing comprising one of ABE7 base editors.

Chimeric Antigen Receptors and Car-T Cells

The invention provides immune cells modified using nucleobase editors described herein that express chimeric antigen receptors (CARs). Modification of immune cells to express a chimeric antigen receptor can enhance an immune cell's immunoreactive activity, wherein the chimeric antigen receptor has an affinity for an epitope on an antigen, wherein the antigen is associated with an altered fitness of an organism. For example, the chimeric antigen receptor can have an affinity for an epitope on a protein expressed in a neoplastic cell. Because the CAR-T cells can act independently of major histocompatibility complex (MHC), activated CAR-T cells can kill the neoplastic cell expressing the antigen. The direct action of the CAR-T cell evades neoplastic cell defensive mechanisms that have evolved in response to MHC presentation of antigens to immune cells.

However, target antigens associated with neoplastic cells may also be expressed on healthy immune cells. Accordingly, activated CAR-T cells not only kill neoplastic cells expressing the target antigen but also healthy immune cells that also express the target antigen. To prevent this fratricide or self-killing of immune cells, the invention provides a CAR-T that has been modified using nucleobase editors to decrease or eliminate the expression of a target antigen (e.g., CD2) to provide fratricide resistance. In some embodiments, the invention provides a fratricide resistant modified immune effector cell that expresses a chimeric antigen receptor to target a neoplastic cell.

Some embodiments comprise autologous immune cell immunotherapy, wherein immune cells are obtained from a subject having a disease or altered fitness characterized by cancerous or otherwise altered cells expressing a surface marker. The obtained immune cells are genetically modified to express a chimeric antigen receptor and are effectively redirected against specific antigens. Thus, in some embodiments, immune cells are obtained from a subject in need of CAR-T immunotherapy. In some embodiments, these autologous immune cells are cultured and modified shortly after they are obtained from the subject. In other embodiments, the autologous cells are obtained and then stored for future use. This practice may be advisable for individuals who may be undergoing parallel treatment that will diminish immune cell counts in the future. In allogeneic immune cell immunotherapy, immune cells can be obtained from a donor other than the subject who will be receiving treatment. In some embodiments, immune cells are obtained from a healthy subject or donor and are genetically modified to express a chimeric antigen receptor and are effectively redirected against specific antigens. The immune cells, after modification to express a chimeric antigen receptor, are administered to a subject for treating a neoplasia (e.g., T- or NK-cell malignancy). In some embodiments, immune cells to be modified to express a chimeric antigen receptor can be obtained from pre-existing stock cultures of immune cells.

Immune cells and/or immune effector cells can be isolated or purified from a sample collected from a subject or a donor using standard techniques known in the art. For example, immune effector cells can be isolated or purified from a whole blood sample by lysing red blood cells and removing peripheral mononuclear blood cells by centrifugation. The immune effector cells can be further isolated or purified using a selective purification method that isolates the immune effector cells based on cell-specific markers such as CD25, CD3, CD4, CD8, CD28, CD45RA, or CD45RO. In one embodiment, $CD4^+$ is used as a marker to select T cells. In one embodiment, $CD8^+$ is used as a marker to select T cells. In one embodiment, $CD4^+$ and $CD8^+$ are used as a marker to select regulatory T cells.

In another embodiment, the invention provides T cells that have targeted gene knockouts at the TCR constant region (TRAC), which is responsible for TCR•• surface expression. TCR••-deficient CAR T cells are compatible with allogenic immunotherapy (Qasim et al., Sci. Transl. Med. 9, eaaj2013 (2017); Valton et al., Mol Ther. 2015 September; 23 (9): 1507-1518). If desired, residual TCR•• T cells are removed using CliniMACS magnetic bead depletion to minimize the risk of GVHD. In another embodiment, the invention provides donor T cells selected ex vivo to recognize minor histocompatibility antigens expressed on recipient hematopoietic cells, thereby minimizing the risk of graft-versus-host disease (GVHD), which is the main cause of morbidity and mortality after transplantation (Warren et al., Blood 2010; 115 (19): 3869-3878). Another technique for isolating or purifying immune effector cells is flow cytometry. In fluorescence activated cell sorting a fluorescently labelled antibody with affinity for an immune effector cell marker is used to label immune effector cells in a sample. A gating strategy appropriate for the cells expressing the marker is used to segregate the cells. For example, T lymphocytes can be separated from other cells in a sample by using, for example, a fluorescently labeled antibody specific for an immune effector cell marker (e.g., CD4, CD8, CD28, CD45) and corresponding gating strategy. In one embodiment, a CD4 gating strategy is employed. In one embodiment, a CD8 gating strategy is employed. In one embodiment, a CD4 and CD8 gating strategy is employed. In some embodiments, a gating strategy for other markers specific to an immune effector cell is employed instead of, or in combination with, the CD4 and/or CD8 gating strategy.

The immune effector cells contemplated in the invention are effector T cells. In some embodiments, the effector T cell is a naïve $CD8^+$ T cell, a cytotoxic T cell, a natural killer T (NKT) cell, a natural killer (NK) cell, or a regulatory T (Treg) cell. In some embodiments, the effector T cells are thymocytes, immature T lymphocytes, mature T lymphocytes, resting T lymphocytes, or activated T lymphocytes. In some embodiments the immune effector cell is a $CD4^+$ $CD8^+$ T cell or a $CD4^-$ $CD8^-$ T cell. In some embodiments the immune effector cell is a T helper cell. In some embodiments the T helper cell is a T helper 1 (Th1), a T helper 2 (Th2) cell, or a helper T cell expressing CD4 (CD4+ T cell). In some embodiments, immune effector cells are effector NK cells. In some embodiments, the immune effector cell is any other subset of T cells. The modified immune effector cell may express, in addition to the chimeric antigen receptor, an exogenous cytokine, a different chimeric receptor, or any other agent that would enhance immune effector cell signaling or function. For example, co-expression of the chimeric antigen receptor and a cytokine may enhance the CAR-T cell's ability to lyse a target cell.

Chimeric antigen receptors as contemplated in the present invention comprise an extracellular binding domain, a transmembrane domain, and an intracellular domain. Binding of an antigen to the extracellular binding domain can activate the CAR-T cell and generate an effector response, which includes CAR-T cell proliferation, cytokine production, and other processes that lead to the death of the antigen expressing cell. In some embodiments of the present invention, the chimeric antigen receptor further comprises a linker. In some embodiments, the linker is a $(GGGGS)_n$ linker (SEQ ID NO: 247). In some embodiments, the linker is a $(GGGGS)_3$ linker (SEQ ID NO: 381). In some embodiments, a CAR of the present invention includes a leader peptide sequence (e.g., N-terminal to the antigen binding domain). An exemplary leader peptide amino acid sequence is:

(SEQ ID NO: 753)
METDTLLLWVLLLWVPGSTG

In various embodiments, the CAR-T specifically targets CD2. Exemplary anti-CD2 CARs include, without limitation, UCART-2 (Wugen Inc.). Exemplary CAR amino acid sequences are provided below:

>pCAR_BTx118 (Rat_LO-CD2a_VL-VH-CD2-3z)
(SEQ ID NO: 754)
METDTLLLWVLLLWVPGSTGDVVLTQTPPTLLATIGQSVSISCRSSQSLLHSSGNTYLNWLL

QRTGQSPQPLIYLVSKLESGVPNRFSGSGSGTDFTLKISGVEAEDLGVYYCMQFTHYPYTFG

AGTKLELKGGGGSGGGGSGGGGSEVQLQQSGPELQRPGASVKLSCKASGYIFTEYYMYWVKQ

RPKQQLELVGRIDPEDGSIDYVEKFKKKATLTADTSSNTAYMQLSSLTSEDTATYFCARGKF

NYRFAYWGQGTLVTVSSSDPTTTPAPRPPTPAPTIASQPLSLRPEACRPAAGGAVHTRGLDF

ACDIYIWAPLAGTCGVLLLSLVITLYC*TKRKKQRSRRNDEELETRAHRVATEERGRKPHQIP*

*ASTPQNPATSQHPPPPPGHRSQAPSHRPPPPGHRVQHQPQKRPPAPSGTQVHQQKGPPLPRP*

-continued

*RVQPKPPHGAAENSLSPSSN*RVKFSRSADAPAYQQGQNQLYNELNLGRREEYDVLDKRRGRD

PEMGGKPRRKNPQEGLYNELQKDKMAEAYSEIGMKGERRRGKGHDGLYQGLSTATKDTYDAL

HMQALPPR*

>pCAR_BTx120 (Rat LO-CD2a VH-VL-CD2-3z)

(SEQ ID NO: 755)

METDTLLLWVLLLWVPGSTGEVQLQQSGPELQRPGASVKLSCKASGYIFTEYYMYWVKQRPK

QQLELVGRIDPEDGSIDYVEKFKKKATLTADTSSNTAYMQLSSLTSEDTATYFCARGKFNYR

FAYWGQGTLVTVSSGGGGSGGGGSGGGGSDVVLTQTPPTLLATIGQSVSISCRSSQSLLHSS

GNTYLNWLLQRTGQSPQPLIYLVSKLESGVPNRFSGSGSGTDFTLKISGVEAEDLGVYYCMQ

FTHYPYTFGAGTKLELKSDPTTTPAPRPPTPAPTIASQPLSLRPEACRPAAGGAVHTRGLDF

ACDIYIWAPLAGTCGVLLLSLVITLYC*TKRKKQRSRRNDEELETRAHRVATEERGRKPHQIP*

*ASTPQNPATSQHPPPPPGHRSQAPSHRPPPPGHRVQHQPQKRPPAPSGTQVHQQKGPPLPRP*

*RVQPKPPHGAAENSLSPSSN*RVKFSRSADAPAYQQGQNQLYNELNLGRREEYDVLDKRRGRD

PEMGGKPRRKNPQEGLYNELQKDKMAEAYSEIGMKGERRRGKGHDGLYQGLSTATKDTYDAL

HMQALPPR*

>pCAR BTx122 (HuLO CD2a VL-HuLO-CD2a VH-CD2-3z)

(SEQ ID NO: 756)

METDTLLLWVLLLWVPGSTGDVVMTQSPPSLLVTLGQPASISCRSSQSLLHSSGNTYLNWLL

QRPGQSPQPLIYLVSKLESGVPDRFSGSGSGTDFTLKISGVEAEDVGVYYCMQFTHYPYTFG

QGTKLEIKGGGGSGGGGSGGGGSQVQLVQSGAEVKKPGASVKVSCKASGYTFTEYYMYWVRQ

APGQGLELMGRIDPEDGSIDYVEKFKKKVTLTADTSSSTAYMELSSLTSDDTAVYYCARGKF

NYRFAYWGQGTLVTVSSSDPTTTPAPRPPTPAPTIASQPLSLRPEACRPAAGGAVHTRGLDF

ACDIYIWAPLAGTCGVLLLSLVITLYC*TKRKKQRSRRNDEELETRAHRVATEERGRKPHQIP*

*ASTPQNPATSQHPPPPPGHRSQAPSHRPPPPGHRVQHQPQKRPPAPSGTQVHQQKGPPLPRP*

*RVQPKPPHGAAENSLSPSSN*RVKFSRSADAPAYQQGQNQLYNELNLGRREEYDVLDKRRGRD

PEMGGKPRRKNPQEGLYNELQKDKMAEAYSEIGMKGERRRGKGHDGLYQGLSTATKDTYDAL

HMQALPPR*

>pCAR_BTx124 (HuLO-CD2a VH-HuLO CD2a VL-CD2-3z)

(SEQ ID NO: 757)

METDTLLLWVLLLWVPGSTGQVQLVQSGAEVKKPGASVKVSCKASGYTFTEYYMYWVRQAPG

QGLELMGRIDPEDGSIDYVEKFKKKVTLTADTSSSTAYMELSSLTSDDTAVYYCARGKFNYR

FAYWGQGTLVTVSSGGGGSGGGGSGGGGSDVVMTQSPPSLLVTLGQPASISCRSSQSLLHSS

GNTYLNWLLQRPGQSPQPLIYLVSKLESGVPDRFSGSGSGTDFTLKISGVEAEDVGVYYCMQ

FTHYPYTFGQGTKLEIKSDPTTTPAPRPPTPAPTIASQPLSLRPEACRPAAGGAVHTRGLDF

ACDIYIWAPLAGTCGVLLLSLVITLYC*TKRKKQRSRRNDEELETRAHRVATEERGRKPHQIP*

*ASTPQNPATSQHPPPPPGHRSQAPSHRPPPPGHRVQHQPQKRPPAPSGTQVHQQKGPPLPRP*

*RVQPKPPHGAAENSLSPSSN*RVKFSRSADAPAYQQGQNQLYNELNLGRREEYDVLDKRRGRD

PEMGGKPRRKNPQEGLYNELQKDKMAEAYSEIGMKGERRRGKGHDGLYQGLSTATKDTYDAL

HMQALPPR*

-continued

>pCAR_BTx126 (HuLO-CD2a VL-MEDI-507 VH-CD2-3z)

(SEQ ID NO: 758)

METDTLLLWVLLLWVPGSTGDVVMTQSPPSLLVTLGQPASISCRSSQSLLHSSGNTYLNWLL

QRPGQSPQPLIYLVSKLESGVPDRFSGSGSGTDFTLKISGVEAEDVGVYYCMQFTHYPYTFG

QGTKLEIKGGGGSGGGGSGGGGSQVQLVQSGAEVKKPGASVKVSCKASGYTFTGYYMHWVRQ

APGQGLEWMGRINPNSGGTNYAQKFQGRVTMTRDTSISTAYMELSRLRSDDTAVYYCARGRT

EYIVVAEGFDYWGQGTLVTVSSSDPTTTPAPRPPTPAPTIASQPLSLRPEACRPAAGGAVHT

RGLDFACDIYIWAPLAGTCGVLLLSLVITLYC*TKRKKQRSRRNDEELETRAHRVATEERGRK*

*PHQIPASTPQNPATSQHPPPPPGHRSQAPSHRPPPPGHRVQHQPQKRPPAPSGTQVHQQKGP*

*PLPRPRVQPKPPHGAAENSLSPSSN*RVKFSRSADAPAYQQGQNQLYNELNLGRREEYDVLDK

RRGRDPEMGGKPRRKNPQEGLYNELQKDKMAEAYSEIGMKGERRRGKGHDGLYQGLSTATKD

TYDALHMQALPPR*

>pCAR_BTx128 (MEDI-507 VH-HuLO-CD2a-CD2-3z)

(SEQ ID NO: 759)

METDTLLLWVLLLWVPGSTGQVQLVQSGAEVKKPGASVKVSCKASGYTFTGYYMHWVRQAPG

QGLEWMGRINPNSGGTNYAQKFQGRVTMTRDTSISTAYMELSRLRSDDTAVYYCARGRTEYI

VVAEGFDYWGQGTLVTVSSGGGGSGGGGSGGGGSDVVMTQSPPSLLVTLGQPASISCRSSQS

LLHSSGNTYLNWLLQRPGQSPQPLIYLVSKLESGVPDRFSGSGSGTDFTLKISGVEAEDVGV

YYCMQFTHYPYTFGQGTKLEIKSDPTTTPAPRPPTPAPTIASQPLSLRPEACRPAAGGAVHT

RGLDFACDIYIWAPLAGTCGVLLLSLVITLYC*TKRKKQRSRRNDEELETRAHRVATEERGRK*

*PHQIPASTPQNPATSQHPPPPPGHRSQAPSHRPPPPGHRVQHQPQKRPPAPSGTQVHQQKGP*

*PLPRPRVQPKPPHGAAENSLSPSSN*RVKFSRSADAPAYQQGQNQLYNELNLGRREEYDVLDK

RRGRDPEMGGKPRRKNPQEGLYNELQKDKMAEAYSEIGMKGERRRGKGHDGLYQGLSTATKD

TYDALHMQALPPR*

>pCAR_BTx119 (Rat LO-CD2a VL-VH-CD28-3z)

(SEQ ID NO: 761)

METDTLLLWVLLLWVPGSTGDVVLTQTPPTLLATIGQSVSISCRSSQSLLHSSGNTYLNWLL

QRTGQSPQPLIYLVSKLESGVPNRFSGSGSGTDFTLKISGVEAEDLGVYYCMQFTHYPYTFG

AGTKLELKGGGGSGGGGSGGGGSEVQLQQSGPELQRPGASVKLSCKASGYIFTEYYMYWVKQ

RPKQQLELVGRIDPEDGSIDYVEKFKKKATLTADTSSNTAYMQLSSLTSEDTATYFCARGKF

NYRFAYWGQGTLVTVSSSDPTTTPAPRPPTPAPTIASQPLSLRPEACRPAAGGAVHTRGLDF

ACDIYIWAPLAGTCGVLLLSLVITLYCRSKRSRLLHSDYMNMTPRRPGPTRKHYQPYAPPRD

FAAYRSRVKFSRSADAPAYQQGQNQLYNELNLGRREEYDVLDKRRGRDPEMGGKPRRKNPQE

GLYNELQKDKMAEAYSEIGMKGERRRGKGHDGLYQGLSTATDTYDALHMQALPPR

>pCAR_BTx121 (Rat LO-CD2a VH-VL-CD28-3z)

(SEQ ID NO: 762)

METDTLLLWVLLLWVPGSTGEVQLQQSGPELQRPGASVKLSCKASGYIFTEYYMYWVKQRPK

QQLELVGRIDPEDGSIDYVEKFKKKATLTADTSSNTAYMQLSSLTSEDTATYFCARGKFNYR

FAYWGQGTLVTVSSGGGGSGGGGSGGGGSDVVLTQTPPTLLATIGQSVSISCRSSQSLLHSS

GNTYLNWLLQRTGQSPQPLIYLVSKLESGVPNRFSGSGSGTDFTLKISGVEAEDLGVYYCMQ

FTHYPYTFGAGTKLELKSDPTTTPAPRPPTPAPTIASQPLSLRPEACRPAAGGAVHTRGLDF

ACDIYIWAPLAGTCGVLLLSLVITLYCRSKRSRLLHSDYMNMTPRRPGPTRKHYQPYAPPRD

-continued

FAAYRSRVKFSRSADAPAYQQGQNQLYNELNLGRREEYDVLDKRRGRDPEMGGKPRRKNPQE

GLYNELQKDKMAEAYSEIGMKGERRRGKGHDGLYQGLSTATDTYDALHMQALPPR

>pCAR_BTx123 (HuLO CD2a VL-HuLO-CD2a VH-CD28-3z)
(SEQ ID NO: 763)

METDTLLLWVLLLWVPGSTGDVVMTQSPPSLLVTLGQPASISCRSSQSLLHSSGNTYLNWLL

QRPGQSPQPLIYLVSKLESGVPDRFSGSGSGTDFTLKISGVEAEDVGVYYCMQFTHYPYTFG

QGTKLEIKGGGGSGGGGSGGGGSQVQLVQSGAEVKKPGASVKVSCKASGYTFTEYYMYWVRQ

APGQGLELMGRIDPEDGSIDYVEKFKKKVTLTADTSSSTAYMELSSLTSDDTAVYYCARGKF

NYRFAYWGQGTLVTVSSSDPTTTPAPRPPTPAPTIASQPLSLRPEACRPAAGGAVHTRGLDF

ACDIYIWAPLAGTCGVLLLSLVITLYCRSKRSRLLHSDYMNMTPRRPGPTRKHYQPYAPPRD

FAAYRSRVKFSRSADAPAYQQGQNQLYNELNLGRREEYDVLDKRRGRDPEMGGKPRRKNPQE

GLYNELQKDKMAEAYSEIGMKGERRRGKGHDGLYQGLSTATDTYDALHMQALPPR

>pCAR_BTx125 (HuLO-CD2a VH-HuLO CD2a VL-CD28-3z)
(SEQ ID NO: 764)

METDTLLLWVLLLWVPGSTGQVQLVQSGAEVKKPGASVKVSCKASGYTFTEYYMYWVRQAPG

QGLELMGRIDPEDGSIDYVEKFKKKVTLTADTSSSTAYMELSSLTSDDTAVYYCARGKFNYR

FAYWGQGTLVTVSSGGGGSGGGGSGGGGSDVVMTQSPPSLLVTLGQPASISCRSSQSLLHSS

GNTYLNWLLQRPGQSPQPLIYLVSKLESGVPDRFSGSGSGTDFTLKISGVEAEDVGVYYCMQ

FTHYPYTFGQGTKLEIKSDPTTTPAPRPPTPAPTIASQPLSLRPEACRPAAGGAVHTRGLDF

ACDIYIWAPLAGTCGVLLLSLVITLYCRSKRSRLLHSDYMNMTPRRPGPTRKHYQPYAPPRD

FAAYRSRVKFSRSADAPAYQQGQNQLYNELNLGRREEYDVLDKRRGRDPEMGGKPRRKNPQE

GLYNELQKDKMAEAYSEIGMKGERRRGKGHDGLYQGLSTATDTYDALHMQALPPR

>pCAR_BTx127 (HuLO-CD2a VL-MEDI-507 VH-CD28-3z)
(SEQ ID NO: 765)

METDTLLLWVLLLWVPGSTGDVVMTQSPPSLLVTLGQPASISCRSSQSLLHSSGNTYLNWLL

QRPGQSPQPLIYLVSKLESGVPDRFSGSGSGTDFTLKISGVEAEDVGVYYCMQFTHYPYTFG

QGTKLEIKGGGGSGGGGSGGGGSQVQLVQSGAEVKKPGASVKVSCKASGYTFTGYYMHWVRQ

APGQGLEWMGRINPNSGGTNYAQKFQGRVTMTRDTSISTAYMELSRLRSDDTAVYYCARGRT

EYIVVAEGFDYWGQGTLVTVSSSDPTTTPAPRPPTPAPTIASQPLSLRPEACRPAAGGAVHT

RGLDFACDIYIWAPLAGTCGVLLLSLVITLYCRSKRSRLLHSDYMNMTPRRPGPTRKHYQPY

APPRDFAAYRSRVKFSRSADAPAYQQGQNQLYNELNLGRREEYDVLDKRRGRDPEMGGKPRR

KNPQEGLYNELQKDKMAEAYSEIGMKGERRRGKGHDGLYQGLSTATDTYDALHMQALPPR

>pCAR_BTx129 (MEDI-507 VH-HuLO-CD2a-CD28-3z)
(SEQ ID NO: 766)

METDTLLLWVLLLWVPGSTGQVQLVQSGAEVKKPGASVKVSCKASGYTFTGYYMHWVRQAPG

QGLEWMGRINPNSGGTNYAQKFQGRVTMTRDTSISTAYMELSRLRSDDTAVYYCARGRTEYI

VVAEGFDYWGQGTLVTVSSGGGGSGGGGSGGGGSDVVMTQSPPSLLVTLGQPASISCRSSQS

LLHSSGNTYLNWLLQRPGQSPQPLIYLVSKLESGVPDRFSGSGSGTDFTLKISGVEAEDVGV

YYCMQFTHYPYTFGQGTKLEIKSDPTTTPAPRPPTPAPTIASQPLSLRPEACRPAAGGAVHT

-continued

RGLDFACDIYIWAPLAGTCGVLLLSLVITLYCRSKRSRLLHSDYMNMTPRRPGPTRKHYQPY

APPRDFAAYRSRVKFSRSADAPAYQQGQNQLYNELNLGRREEYDVLDKRRGRDPEMGGKPRR

KNPQEGLYNELQKDKMAEAYSEIGMKGERRRGKGHDGLYQGLSTATDTYDALHMQALPPR

In the above sequences, the asterisk (*) denotes a stop codon, the sequence in bold denotes an anti-CD2 scFv sequence, the underlined sequence denotes the signal peptide, the double underlined sequence denotes a CD8• transmembrane domain, the italicized sequence denotes the CD2 cytoplasmic signaling domain or co-stimulatory domain, the plain text sequence denotes the CD28 cytoplasmic signaling domain or co-stimulatory domain, and the dotted underlined sequence denotes the CD3zeta functional domain or TCR signaling domain. In various embodiments, the CAR specifically binds CD5. Exemplary anti-CD5 CARs include, without limitation, CD5CAR (iCell Gene Therapeutics). In various embodiments, the CAR specifically binds CD7. Exemplary anti-CD7 CARs include, without limitation, CAR-pNK (PersonGen Biomedicine (Suzhou) Co Ltd), and CD7.CAR/28zeta CAR T cells (Baylor College of Medicine), UCART7 (Washington University in St Louis).

In various embodiments, the CAR-T cells have low levels of tonic signaling. In embodiments, the tonic signaling is about or less than about 10, 9, 8, 7, 6, 5, 4, 3, 2, 0.5, or 0.1 times the tonic signaling in a reference cell. Non-limiting examples of a reference cell is a T cell not expressing a CAR or a T cell expressing a reference CAR.

Provided herein are also nucleic acids that encode the chimeric antigen receptors described herein. In some embodiments, the nucleic acid is isolated or purified. Delivery of the nucleic acids ex vivo can be accomplished using methods known in the art. For example, immune cells obtained from a subject may be transformed with a nucleic acid vector encoding the chimeric antigen receptor. The vector may then be used to transform recipient immune cells so that these cells will then express the chimeric antigen receptor. Efficient means of transforming immune cells include transfection and transduction. Such methods are well known in the art. For example, applicable methods for delivery the nucleic acid molecule encoding the chimeric antigen receptor (and the nucleic acid(s) encoding the base editor) can be found in International Application No. PCT/US2009/040040 and U.S. Pat. Nos. 8,450,112; 9,132,153; and 9,669,058, each of which is incorporated herein in its entirety. Additionally, those methods and vectors described herein for delivering the nucleic acid encoding the base editor are applicable to delivering the nucleic acid encoding the chimeric antigen receptor.

In embodiments, about or at least about 10%, 20%, 30%, 40%, 50%, 55%, 60%, 65%, 70%, 75%, 80%, 85%, 90%, or 95% of a population of cells transduced with a polynucleotide encoding a chimeric antigen receptor (CAR) of the present disclosure (e.g., those listed above) surface-express the CAR.

Some aspects of the present invention provide for immune cells comprising a chimeric antigen and an altered endogenous gene that provides resistance to fratricide, enhances immune cell function, resistance to immunosuppression or inhibition, or a combination thereof. In some embodiments, the altered endogenous gene may be created by base editing. In some embodiments, the base editing may reduce or attenuate the gene expression. In some embodiments, the base editing may reduce or attenuate the gene activation. In some embodiments, the base editing may reduce or attenuate the functionality of the gene product. In some other embodiments, the base editing may activate or enhance the gene expression. In some embodiments, the base editing may increase the functionality of the gene product. In some embodiments, the altered endogenous gene may be modified or edited in an exon, an intron, an exon-intron injunction, or a regulatory element thereof. The modification may be edit to a single nucleobase in a gene or a regulatory element thereof. The modification may be in a exon, more than one exons, an intron, or more than one introns, or a combination thereof. The modification may be in an open reading frame of a gene. The modification may be in an untranslated region of the gene, for example, a 3'-UTR or a 5'-UTR. In some embodiments, the modification is in a regulatory element of an endogenous gene. In some embodiments, the modification is in a promoter, an enhancer, an operator, a silencer, an insulator, a terminator, a transcription initiation sequence, a translation initiation sequence (e.g. a Kozak sequence), or any combination thereof.

Allogeneic immune cells expressing an endogenous immune cell receptor as well as a chimeric antigen receptor may recognize and attack host cells, a circumstance termed graft versus host disease (GVHD). The alpha component of the immune cell receptor complex is encoded by the TRAC gene, and in some embodiments, this gene is edited such that the alpha subunit of the TCR complex is nonfunctional or absent. Because this subunit is necessary for endogenous immune cell signaling, editing this gene can reduce the risk of graft versus host disease caused by allogeneic immune cells.

In some embodiments of the present invention, the PDCD1 gene is edited in the CAR-T cell to knockout or knockdown expression. The PDCD1 gene encodes the cell surface receptor PD-1, an immune system checkpoint expressed in immune cells, and it is involved in reducing autoimmunity by promoting apoptosis of antigen specific immune cells. By knocking out or knocking down expression of the PDCD1 gene, the modified CAR-T cells are less likely to apoptose, are more likely to proliferate, and can escape the programmed cell death immune checkpoint. In some embodiments, editing of genes to provide fratricide resistance, enhance the function of the immune cell or to reduce immunosuppression or inhibition can occur in the immune cell before the cell is transformed to express a chimeric antigen receptor. In other aspects, editing of genes to provide fratricide resistance, enhance the function of the immune cell or to reduce immunosuppression or inhibition can occur in a CAR-T cell, i.e., after the immune cell has been transformed to express a chimeric antigen receptor.

In some embodiments of the present invention, the CD2 gene is edited in the CAR-T cell to knockout or knockdown expression. The CAR-T is then transformed to express a chimeric antigen receptor with a CD2 co-stimulatory domain. By knocking out or knocking down expression of the CD2 gene, the modified CAR-T cells are less likely to commit fratricide.

In some embodiments, the immune cell may comprise a chimeric antigen receptor (CAR) and one or more edited genes, one or more regulatory elements thereof, or combinations thereof, wherein expression of the edited gene is either knocked out or knocked down. In some embodiments, the CAR-T cells have increased fratricide resistance as compared to a similar CAR-T cell but without further having the one or more edited genes as described herein. In some embodiments, the CAR-T cells have reduced immunogenicity as compared to a similar CAR-T cell but without further having the one or more edited genes as described herein. In some embodiments, the CAR-T cells have lower activation threshold as compared to a similar CAR-T but without further having the one or more edited genes as described herein. In some embodiments, the CAR-T cells have increased anti-neoplasia activity as compared to a similar CAR-T cell but without further having the one or more edited genes as described herein. The one or more genes may be edited by base editing. In some embodiments the one or more genes, or one or more regulatory elements thereof, or combinations thereof, may be selected from a group consisting of: CD2 antigen (CD2); CD3 antigen (CD3); CD5 antigen (CD5); CD7 antigen (CD7); CD52 antigen (CD52); T cell receptor alpha constant (TRAC); and Programmed cell death 1 (PDCD1 or PD-1). In some embodiments, CD2, CD5, or CD7 is edited. In some embodiments, CD2, CD5, or CD7 is edited in combination with one or more of CD3, CD52, TRAC, and/or PD-1.

In some embodiments, an immune cell comprises a chimeric antigen receptor and one or more edited genes, a regulatory element thereof, or combinations thereof. An edited gene may be an immune response regulation gene, an immunogenic gene, a checkpoint inhibitor gene, a gene involved in immune responses, a cell surface marker, e.g. a T cell surface marker, or any combination thereof. In some embodiments, an immune cell comprises a chimeric antigen receptor and an edited gene that is associated with activated T cell proliferation, alpha-beta T cell activation, gamma-delta T cell activation, positive regulation of T cell proliferation, negative regulation of T-helper cell proliferation or differentiation, or their regulatory elements thereof, or combinations thereof. In some embodiments, the edited gene may be a checkpoint inhibitor gene, for example, such as a PD1 gene, a PDC1 gene, or a member related to or regulating the pathway of their formation or activation.

In some embodiments, provided herein is an immune cell with an edited TRAC gene (wherein, the TRAC gene may comprise one, two, three, four, five, six, seven eight, nine, ten or more base edits), such that the immune cell does not express an endogenous functional T cell receptor alpha chain. In some embodiments, the immune cell is a T cell expressing a chimeric antigen receptor (a CAR-T cell). In some embodiments, provided herein is a CAR-T cell with base edits in TRAC gene, such that the CAR-T cell have reduced or negligible or no expression of endogenous T cell receptor alpha protein.

In some embodiments, the immune cell comprises an edited CD2 gene, and additionally, at least one edited gene. In some embodiments, the immune cell comprises an edited CD5 gene, and additionally, at least one edited gene. In some embodiments, the immune cell comprises an edited CD7 gene, and additionally, at least one edited gene. The at least one edited gene may be selected from the list of genes mentioned in the preceding paragraphs.

In one embodiment, the immune cell may comprise an edited CD2 gene, an edited PD-1 gene, an edited CD52 gene, an edited TRAC gene, or any combination thereof, wherein expression of the edited gene is either knocked out or knocked down. In some embodiments, the immune cell comprises an edited CD2 gene, an edited PD-1 gene, an edited CD52 gene, and an edited TRAC gene, wherein expression of the edited genes are either knocked out or knocked down.

In one embodiment, the immune cell may comprise an edited CD5 gene, an edited PD-1 gene, an edited CD52 gene, an edited TRAC gene, or any combination thereof, wherein expression of the edited gene is either knocked out or knocked down. In some embodiments, the immune cell comprises an edited CD5 gene, an edited PD-1 gene, an edited CD52 gene, and an edited TRAC gen, wherein expression of the edited genes are either knocked out or knocked down.

In one embodiment, the immune cell may comprise an edited CD7 gene, and edited CD3 gene, an edited PD-1 gene, an edited CD52 gene, an edited TRAC gene, or any combination thereof, wherein expression of the edited gene is either knocked out or knocked down. In some embodiments, the immune cell comprises an edited CD7 gene, an edited PI-1 gene, an edited CD52 gene, and an edited CD3 gene, wherein expression of the edited genes are either knocked out or knocked down.

In some embodiments, provided herein is an immune cell with an edited CIITA gene, such that the immune cell does not express an endogenous functional class II, major histocompatibility complex, transactivator. In some embodiments, provided herein is a CAR-T cell with an edited CIITA gene, such that the CAR-T cell exhibits reduced or negligible expression or no expression of endogenous class II, major histocompatibility complex, transactivator.

In some embodiments, provided herein is an immune cell with an edited TRBC1 or TRBC2 gene, such that the immune cell does not express an endogenous functional T cell receptor beta chain. In some embodiments, provided herein is a CAR-T cell with an edited TRBC1/TRBC2 gene, such that the CAR-T cell exhibits reduced or negligible expression or no expression of endogenous T cell receptor beta chain.

In some embodiments, provided herein is an immune cell with an edited B2M gene, such that the immune cell does not express an endogenous functional Beta-2-microglobulin. In some embodiments, provided herein is a CAR-T cell with an edited B2M gene, such that the CAR-T cell exhibits reduced or negligible expression or no expression of endogenous Beta-2-microglobulin.

In some embodiments, the immune cell comprises an edited CD2 gene, an edited TRBC1 gene, an edited TRBC2 gene, an edited TRAC gene, an edited PD-1 gene, an edited CD52 gene, an edited CD7 gene, an edited CD5 gene, an edited CIITA gene, an edited B2M gene, or a combination thereof. In some embodiments, the immune cell may be a CAR-T cell. In some embodiments, each edited gene may comprise a single base edit. In some embodiments, each edited gene may comprise multiple base edits at different regions of the gene.

In some embodiments, a single modification event (such as electroporation), may introduce one or more gene edits. In some embodiments at least one, two, three, four, five, six, seven, eight, nine, ten, eleven, twelve, thirteen, fourteen, fifteen, sixteen, seventeen, eighteen, nineteen, twenty or more edits may be introduced in one or more genes simultaneously.

In some embodiments, an immune cell, including but not limited to any immune cell comprising an edited gene selected from any of the aforementioned gene edits, can be edited to generate mutations in other genes that enhance the CAR-T's function or reduce immunosuppression or inhibition of the cell.

Extracellular Binding Domain

The chimeric antigen receptors of the invention include an extracellular binding domain. The extracellular binding domain of a chimeric antigen receptor contemplated herein comprises an amino acid sequence of an antibody, or an antigen binding fragment thereof, that has an affinity for a specific antigen. In some embodiments, the antigen is CD2. In some embodiments, the antigen is CD5. In some embodiments, the antigen is CD7.

In some embodiments the chimeric antigen receptor comprises an amino acid sequence of an antibody. In some embodiments, the chimeric antigen receptor comprises the amino acid sequence of an antigen binding fragment of an antibody. The antibody (or fragment thereof) portion of the extracellular binding domain recognizes and binds to an epitope of an antigen. In some embodiments, the antibody fragment portion of a chimeric antigen receptor is a single chain variable fragment (scFv). An scFv comprises the light and variable fragments of a monoclonal antibody. In other embodiments, the antibody fragment portion of a chimeric antigen receptor is a multichain variable fragment, which can comprise more than one extracellular binding domains and therefore bind to more than one antigen simultaneously. In a multiple chain variable fragment embodiment, a hinge region may separate the different variable fragments, providing necessary spatial arrangement and flexibility.

In some embodiments, the extracellular binding domain is an anti-CD2 scFv. In some embodiments, an anti-CD2 scFv is at least 85%, at least 90%, at least 95%, at least 98%, at least 99%, or 100% identical to an exemplary amino acid sequence as provided below:

(SEQ ID NO: 382)
DVVLTQTPPTLLATIGQSVSISCRSSQSLLHSSGNTYLNWLLQRTGQSP
QPLIYLVSKLESGVPNRFSGSGSGTDFTLKISGVEAEDLGVYYCMQFTH
YPYTFGAGTKLELKGGGGSGGGGSGGGGSEVQLQQSGPELQRPGASVKL
SCKASGYIFTEYYMYWVKQRPKQQLELVGRIDPEDGSIDYVEKFKKKAT
LTADTSSNTAYMQLSSLTSEDTATYFCARGKFNYRFAYWGQGTLVTVS
S.

In some embodiments, an anti-CD2 scFv is at least 85%, at least 90%, at least 95%, at least 98%, at least 99%, or 100% identical to an exemplary amino acid sequence as provided below:

(SEQ ID NO: 383)
EVQLQQSGPELQRPGASVKLSCKASGYIFTEYYMYWVKQRPKQQLELVG
RIDPEDGSIDYVEKFKKKATLIADTSSNTAYMQLSSLTSEDTATYFCAR
GKFNYRFAYWGQGTLVTVSSGGGGSGGGGSGGGGSDVVLTQTPPTLLAT
IGQSVSISCRSSQSLLHSSGNTYLNWLLQRTGQSPQPLIYLVSKLESGV
PNRFSGSGSGTDFTLKISGVEAEDLGVYYCMQFTHYPYTFGAGTKLEL
K.

In some embodiments, an anti-CD2 scFv is at least 85%, at least 90%, at least 95%, at least 98%, at least 99%, or 100% identical to an exemplary amino acid sequence as provided below:

(SEQ ID NO: 384)
DVVMTQSPPSLLVTLGQPASISCRSSQSLLHSSGNTYLNWLLQRPGQSP
QPLIYLVSKLESGVPDRFSGSGSGTDFTLKISGVEAEDVGVYYCMQFTH
YPYTFGQGTKLEIKGGGGSGGGGSGGGGSQVQLVQSGAEVKKPGASVKV
SCKASGYTFTEYYMYWVRQAPGQGLELMGRIDPEDGSIDYVEKFKKKVT
LTADTSSSTAYMELSSLTSDDTAVYYCARGKFNYRFAYWGQGTLVTVS
S.

In some embodiments, an anti-CD2 scFv is at least 85%, at least 90%, at least 95%, at least 98%, at least 99%, or 100% identical to an exemplary amino acid sequence as provided below:

(SEQ ID NO: 385)
QVQLVQSGAEVKKPGASVKVSCKASGYTFTEYYMYWVRQAPGQGLELMG
RIDPEDGSIDYVEKFKKKVTLTADTSSSTAYMELSSLTSDDTAVYYCAR
GKFNYRFAYWGQGTLVTVSSGGGGSGGGGSGGGGSDVVMTQSPPSLLVT
LGQPASISCRSSQSLLHSSGNTYLNWLLQRPGQSPQPLIYLVSKLESGV
PDRFSGSGSGTDFTLKISGVEAEDVGVYYCMQFTHYPYTFGQGTKLEI
K.

In some embodiments, an anti-CD2 scFv is at least 85%, at least 90%, at least 95%, at least 98%, at least 99%, or 100% identical to an exemplary amino acid sequence as provided below:

(SEQ ID NO: 386)
DVVMTQSPPSLLVTLGQPASISCRSSQSLLHSSGNTYLNWLLQRPGQSP
QPLIYLVSKLESGVPDRFSGSGSGTDFTLKISGVEAEDVGVYYCMQFTH
YPYTFGQGTKLEIKGGGGSGGGGSGGGGSQVQLVQSGAEVKKPGASVKV
SCKASGYTFTGYYMHWVRQAPGQGLEWMGRINPNSGGTNYAQKFQGRVT
MTRDTSISTAYMELSRLRSDDTAVYYCARGRTEYIVVAEGFDYWGQGTL
VTVSS.

In some embodiments, an anti-CD2 scFv is at least 85%, at least 90%, at least 95%, at least 98%, at least 99%, or 100% identical to an exemplary amino acid sequence as provided below:

(SEQ ID NO: 387)
QVQLVQSGAEVKKPGASVKVSCKASGYTFTGYYMHWVRQAPGQGLEWMG
RINPNSGGTNYAQKFQGRVTMTRDTSISTAYMELSRLRSDDTAVYYCAR
GRTEYIVVAEGFDYWGQGTLVTVSSGGGGSGGGGSGGGGSDVVMTQSPP
SLLVTLGQPASISCRSSQSLLHSSGNTYLNWLLQRPGQSPQPLIYLVSK
LESGVPDRFSGSGSGTDFTLKISGVEAEDVGVYYCMQFTHYPYTFGQGT
KLEIK.

In other embodiments, the antibody portion of a chimeric antigen receptor comprises at least one heavy chain and at least one light chain. In some embodiments, the antibody portion of a chimeric antigen receptor comprises two heavy chains, joined by disulfide bridges and two light chains, wherein the light chains are each joined to one of the heavy chains by disulfide bridges. In some embodiments, the light chain comprises a constant region and a variable region. Complementarity determining regions residing in the variable region of an antibody are responsible for the antibody's affinity for a particular antigen. Thus, antibodies that recognize different antigens comprise different complementarity determining regions. Complementarity determining regions reside in the variable domains of the extracellular binding domain, and variable domains (i.e., the variable heavy and variable light) can be linked with a linker or, in some embodiments, with disulfide bridges. In some embodiments, the variable heavy chain and variable light chain are linked by a $(GGGGS)_n$ linker (SEQ ID NO: 247), wherein the n is an integer from 1 to 10. In some embodiments, the linker is a $(GGGGS)_3$ linker (SEQ ID NO: 381).

In some embodiments, the antibody portion of a chimeric antigen receptor comprises at least one anti-CD2 light chain. In some embodiments, an anti-CD2 light chain is at least 85%, at least 90%, at least 95%, at least 98%, at least 99%, or 100% identical to an exemplary amino acid sequence as provided below:

(SEQ ID NO: 376)
DVVLTQTPPTLLATIGQSVSISCRSSQSLLHSSGNTYLNWLLQRTGQSP
QPLIYLVSKLESGVPNRFSGSGSGTDFTLKISGVEAEDLGVYYCMQFTH
YPYTFGAGTKLELK

In some embodiments, an anti-CD2 light chain is at least 85%, at least 90%, at least 95%, at least 98%, at least 99%, or 100% identical to an exemplary amino acid sequence as provided below:

(SEQ ID NO: 377)
EVQLQQSGPELQRPGASVKLSCKASGYIFTEYYMYWVKQRPKQQLELVG
RIDPEDGSIDYVEKFKKKATLTADTSSNTAYMQLSSLTSEDTATYFCAR
GKFNYRFAYWGQGTLVTVSS

In some embodiments, an anti-CD2 light chain is at least 85%, at least 90%, at least 95%, at least 98%, at least 99%, or 100% identical to an exemplary amino acid sequence as provided below:

(SEQ ID NO: 378)
DVVMTQSPPSLLVTLGQPASISCRSSQSLLHSSGNTYLNWLLQRPGQSP
QPLIYLVSKLESGVPDRFSGSGSGTDFTLKISGVEAEDVGVYYCMQFTH
YPYTFGQGTKLEIK.

In some embodiments, an anti-CD2 light chain is at least 85%, at least 90%, at least 95%, at least 98%, at least 99%, or 100% identical to an exemplary amino acid sequence as provided below:

(SEQ ID NO: 379)
QVQLVQSGAEVKKPGASVKVSCKASGYTFTEYYMYWVRQAPGQGLELMG
RIDPEDGSIDYVEKFKKKVTLTADTSSSTAYMELSSLTSDDTAVYYCAR
GKFNYRFAYWGQGTLVTVSS.

In some embodiments, an anti-CD2 light chain is at least 85%, at least 90%, at least 95%, at least 98%, at least 99%, or 100% identical to an exemplary amino acid sequence as provided below:

(SEQ ID NO: 378)
DVVMTQSPPSLLVTLGQPASISCRSSQSLLHSSGNTYLNWLLQRPGQSP
QPLIYLVSKLESGVPDRFSGSGSGTDFTLKISGVEAEDVGVYYCMQFTH
YPYTFGQGTKLEIK.

In some embodiments, an anti-CD2 light chain is at least 85%, at least 90%, at least 95%, at least 98%, at least 99%, or 100% identical to an exemplary amino acid sequence as provided below:

(SEQ ID NO: 380)
QVQLVQSGAEVKKPGASVKVSCKASGYTFTGYYMHWVRQAPGQGLEWMG
RINPNSGGTNYAQKFQGRVTMTRDTSISTAYMELSRLRSDDTAVYYCAR
GRTEYIVVAEGFDYWGQGTLVTVSS.

In some embodiments, the antibody portion of a chimeric antigen receptor comprises at least one anti-CD2 heavy chain. In some embodiments, an anti-CD2 scFv heavy chain is at least 85%, at least 90%, at least 95%, at least 98%, at least 99%, or 100% identical to an exemplary amino acid sequence as provided below:

(SEQ ID NO: 377)
EVQLQQSGPELQRPGASVKLSCKASGYIFTEYYMYWVKQRPKQQLELVG
RIDPEDGSIDYVEKFKKKATLTADTSSNTAYMQLSSLTSEDTATYFCAR
GKFNYRFAYWGQGTLVTVSS

In some embodiments, the antibody portion of a chimeric antigen receptor comprises at least one anti-CD2 heavy chain. In some embodiments, an anti-CD2 scFv heavy chain is at least 85%, at least 90%, at least 95%, at least 98%, at least 99%, or 100% identical to an exemplary amino acid sequence as provided below:

(SEQ ID NO: 376)
DVVLTQTPPTLLATIGQSVSISCRSSQSLLHSSGNTYLNWLLQRTGQSP
QPLIYLVSKLESGVPNRFSGSGSGTDFTLKISGVEAEDLGVYYCMQQFT
HYPYTFGAGTKLELK

In some embodiments, the antibody portion of a chimeric antigen receptor comprises at least one anti-CD2 heavy chain. In some embodiments, an anti-CD2 scFv heavy chain is at least 85%, at least 90%, at least 95%, at least 98%, at least 99%, or 100% identical to an exemplary amino acid sequence as provided below:

(SEQ ID NO: 379)
QVQLVQSGAEVKKPGASVKVSCKASGYTFTEYYMYWVRQAPGQGLELMG
RIDPEDGSIDYVEKFKKKVTLTADTSSSTAYMELSSLTSDDTAVYYCAR
GKFNYRFAYWGQGTLVTVSS.

In some embodiments, the antibody portion of a chimeric antigen receptor comprises at least one anti-CD2 heavy chain. In some embodiments, an anti-CD2 scFv heavy chain is at least 85%, at least 90%, at least 95%, at least 98%, at least 99%, or 100% identical to an exemplary amino acid sequence as provided below:

(SEQ ID NO: 378)
DVVMTQSPPSLLVTLGQPASISCRSSQSLLHSSGNTYLNWLLQRPGQSP

QPLIYLVSKLESGVPDRFSGSGSGTDFTLKISGVEAEDVGVYYCMQFTH

YPYTFGQGTKLEIK.

In some embodiments, the antibody portion of a chimeric antigen receptor comprises at least one anti-CD2 heavy chain. In some embodiments, an anti-CD2 scFv heavy chain is at least 85%, at least 90%, at least 95%, at least 98%, at least 99%, or 100% identical to an exemplary amino acid sequence as provided below:

(SEQ ID NO: 380)
QVQLVQSGAEVKKPGASVKVSCKASGYTFTGYYMHWVRQAPGQGLEWMG

RINPNSGGTNYAQKFQGRVTMTRDTSISTAYMELSRLRSDDTAVYYCAR

GRTEYIVVAEGFDYWGQGTLVTVSS.

In some embodiments, the antibody portion of a chimeric antigen receptor comprises at least one anti-CD2 heavy chain. In some embodiments, an anti-CD2 scFv heavy chain is at least 85%, at least 90%, at least 95%, at least 98%, at least 99%, or 100% identical to an exemplary amino acid sequence as provided below:

(SEQ ID NO: 378)
DVVMTQSPPSLLVTLGQPASISCRSSQSLLHSSGNTYLNWLLQRPGQSP

QPLIYLVSKLESGVPDRFSGSGSGTDFTLKISGVEAEDVGVYYCMQFTH

YPYTFGQGTKLEIK.

In some embodiments, the antigen recognized and bound by the extracellular domain is a protein or peptide, a nucleic acid, a lipid, or a polysaccharide. Antigens can be heterologous, such as those expressed in a pathogenic bacteria or virus. Antigens can also be synthetic; for example, some individuals have extreme allergies to synthetic latex and exposure to this antigen can result in an extreme immune reaction. In some embodiments, the antigen is autologous, and is expressed on a diseased or otherwise altered cell. For example, in some embodiments, the antigen is expressed in a neoplastic cell. In some embodiments, the neoplastic cell is a malignant T- or NK-cell. In some embodiments, the malignant T- or NK-cell is a malignant precursor T- or NK-cell. In some embodiments, the malignant T- or NK-cell is a malignant mature T- or NK-cell. Nonlimiting examples of neoplasia include T-cell acute lymphoblastic leukemia (T-ALL), mycosis fungoides (MF), Sezary syndrome (SS), Peripheral T/NK•cell lymphoma, Anaplastic large cell lymphoma ALK+, Primary cutaneous T•cell lymphoma, T•cell large granular lymphocytic leukemia, Angioimmunoblastic T/NK•cell lymphoma, Hepatosplenic T•cell lymphoma, Primary cutaneous CD30+lymphoproliferative disorders, Extranodal NK/T•cell lymphoma, Adult T• cell leukemia/lymphoma, T•cell prolymphocytic leukemia, Subcutaneous panniculitis•like T-cell lymphoma, Primary cutaneous gamma-delta T•cell lymphoma, Aggressive NK•cell leukemia, and Enteropathy•associated T•cell lymphoma.

Antibody-antigen interactions are noncovalent interactions resulting from hydrogen bonding, electrostatic or hydrophobic interactions, or from van der Waals forces. The affinity of extracellular binding domain of the chimeric antigen receptor for an antigen can be calculated with the following formula:

$K_A$=[Antibody-Antigen]/[Antibody] [Antigen], wherein

[Ab]=molar concentration of unoccupied binding sites on the antibody;

[Ag]=molar concentration of unoccupied binding sites on the antigen; and

[Ab-Ag]=molar concentration of the antibody-antigen complex.

The antibody-antigen interaction can also be characterized based on the dissociation of the antigen from the antibody. The dissociation constant ($K_D$) is the ratio of the association rate to the dissociation rate and is inversely proportional to the affinity constant. Thus, $K_D=1/K_A$. Those skilled in the art will be familiar with these concepts and will know that traditional methods, such as ELISA assays, can be used to calculate these constants.

Transmembrane Domain

The chimeric antigen receptors of the invention include a transmembrane domain. The transmembrane domain of the chimeric antigen receptors described herein spans the CAR-T cell's lipid bilayer cellular membrane and separates the extracellular binding domain and the intracellular signaling domain. In some embodiments, this domain is derived from other receptors having a transmembrane domain, while in other embodiments, this domain is synthetic. In some embodiments, the transmembrane domain may be derived from a non-human transmembrane domain and, in some embodiments, humanized. By "humanized" is meant having the sequence of the nucleic acid encoding the transmembrane domain optimized such that it is more reliably or efficiently expressed in a human subject. In some embodiments, the transmembrane domain is derived from another transmembrane protein expressed in a human immune effector cell. Examples of such proteins include, but are not limited to, subunits of the T cell receptor (TCR) complex, PD1, or any of the Cluster of Differentiation proteins, or other proteins, that are expressed in the immune effector cell and that have a transmembrane domain. In some embodiments, the transmembrane domain will be synthetic, and such sequences will comprise many hydrophobic residues.

Transmembrane domains for use in the disclosed CARs can include at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some embodiments, the transmembrane domain is derived from CD4, CD8•, CD28 and CD3•.

In some embodiments the transmembrane domain is a CD8• hinge and transmembrane domain. In some embodiments, the CD8• hinge and transmembrane domain is at least 85%, at least 90%, at least 95%, at least 98%, at least 99%, or 100% identical to an exemplary amino acid sequence as provided below:

(SEQ ID NO: 371)
SDPTTTPAPRPPTPAPTIASQPLSLRPEACRPAAGGAVHTRGLDFACDI

YIWAPLAGTCGVLLLSLVITLYC

The chimeric antigen receptor is designed, in some embodiments, to comprise a spacer between the transmembrane domain and the extracellular domain, the intracellular domain, or both. Such spacers can be 1, 2, 3, 4, 5, 6, 7, 8, 9, 10, 11, 12, 13, 14, 15, 16, 17, 18, 19, or 20 amino acids in length. In some embodiments, the spacer can be 20, 30, 40, 50, 60, 70, 80, 90, or 100 amino acids in length. In still other embodiments the spacer can be between 100 and 500 amino acids in length. The spacer can be any polypeptide that links one domain to another and are used to position such linked domains to enhance or optimize chimeric antigen receptor function.

Intracellular Signaling Domain

The chimeric antigen receptors of the invention include an intracellular signaling domain. The intracellular signaling domain is the intracellular portion of a protein expressed in a T cell that transduces a T cell effector function signal (e.g., an activation signal) and directs the T cell to perform a specialized function. T cell activation can be induced by a number of factors, including binding of cognate antigen to the T cell receptor on the surface of T cells and binding of cognate ligand to costimulatory molecules on the surface of the T cell. A T cell co-stimulatory molecule is a cognate binding partner on a T cell that specifically binds with a co-stimulatory ligand, thereby mediating a co-stimulatory response by the T cell, such as, but not limited to, proliferation. Co-stimulatory molecules include, but are not limited to an MHC class I molecule. Activation of a T cell leads to immune response, Such as T cell proliferation and differentiation (see, e.g., Smith-Garvin et al., Annu. Rev. Immunol., 27:591-619, 2009). Exemplary T cell signaling domains are known in the art. Non-limiting examples include the CD3•, CD8, CD28, CD27, CD154, GITR (TNFRSF18), CD134 (OX40), and CD137 (4-1BB) signaling domains.

The intracellular signaling domain of the chimeric antigen receptor contemplated herein comprises a primary signaling domain. In some embodiments, the chimeric antigen receptor comprises the primary signaling domain and a secondary, or co-stimulatory, signaling domain.

In some embodiments, the primary signaling domain comprises one or more immunoreceptor tyrosine-based activation motifs, or ITAMs. In some embodiments, the primary signaling domain comprises more than one ITAM. ITAMs incorporated into the chimeric antigen receptor may be derived from ITAMs from other cellular receptors. In some embodiments, the primary signaling domain comprising an ITAM may be derived from subunits of the TCR complex, such as CD3•, CD3•, CD3•, or CD3•. In some embodiments, the primary signaling domain comprising an ITAM may be derived from FcR•, FcR•, CD5, CD22, CD79a, CD79b, or CD66d.

In some embodiments, the primary signaling domain is selected from the group consisting of CD8, CD28, CD134 (OX40), CD137 (4-1BB), and CD3•.

In some embodiments, the primary signaling domain is a CD3• signaling domain. In some embodiments, the CD3• signaling domain is at least 85%, at least 90%, at least 95%, at least 98%, at least 99%, or 100% identical to an exemplary amino acid sequence as provided below:

```
(SEQ ID NO: 372)
RVKFSRSADAPAYQQGQNQLYNELNLGRREEYDVLDKRRGRDPEMGGKP

RRKNPQEGLYNELQKDKMAEAYSEIGMKGERRRGKGHDGLYQGLSTATK

DTYDALHMQALPPR
```

In some embodiments, the primary signaling domain is a CD28 signaling domain. In some embodiments, the CD28 signaling domain is at least 85%, at least 90%, at least 95%, at least 98%, at least 99%, or 100% identical to an exemplary amino acid sequence as provided below:

```
(SEQ ID NO: 373)
RSKRSRLLHSDYMNMTPRRPGPTRKHYQPYAPPRDFAAYRS
```

In some embodiments, the primary signaling domain is a CD137 (4-1BB) signaling domain. In some embodiments, the CD137 (4-1BB) signaling domain is at least 85%, at least 90%, at least 95%, at least 98%, at least 99%, or 100% identical to an exemplary amino acid sequence as provided below:

```
(SEQ ID NO: 374)
KRGRKKLLYIFKQPFMRPVQTTQEEDGCSCRFPEEEEGGCEL
```

In some embodiments, the CD137 (4-1BB) signaling domain is at least 85%, at least 90%, at least 95%, at least 98%, at least 99%, or 100% identical to an exemplary amino acid sequence as provided below:

```
(SEQ ID NO: 375)
RFSVVKRGRKKLLYIFKQPFMRPVQTTQEEDGCSCRFPEEEEGGCEL
```

In some embodiments, the primary signaling domain is a CD134 (OX40) signaling domain. In some embodiments, the CD134 (OX40) signaling domain is at least 85%, at least 90%, at least 95%, at least 98%, at least 99%, or 100% identical to an exemplary amino acid sequence as provided below:

```
(SEQ ID NO: 760)
RRDQRLPPDAHKPPGGGSFRTPIQEEQADAHSTLAKI
```

In some embodiments, the secondary, or co-stimulatory, signaling domain is derived from CD2, CD4, CD5, CD8•, CD28, CD83, CD134, CD137 (4-1BB), ICOS, or CD154, or a combination thereof. In some embodiments, the co-signaling domain is a CD2 cytoplasmic domain. In some embodiments, the CD2 signaling domain is at least 85%, at least 90%, at least 95%, at least 98%, at least 99%, or 100% identical to an exemplary amino acid sequence as provided below:

```
(SEQ ID NO: 370)
TKRKKQRSRRNDEELETRAHRVATEERGRKPHQIPASTPQNPATSQHPP

PPPGHRSQAPSHRPPPPGHRVQHQPQKRPPAPSGTQVHQQKGPPLPRPR

VQPKPPHGAAENSLSPSSN
```

In some embodiments, the CAR comprises one or more signaling domains. In some embodiments, the CAR comprises a CD2 signaling domain and a CD3• signaling domain. In some embodiments, the CAR comprises a CD2 signaling domain and a CD28 signaling domain. In some embodiments, the CAR comprises a CD2 signaling domain and a CD137 (4-1BB) signaling domain. In some embodiments, the CAR comprises a CD2 signaling domain, a CD28 signaling domain, and a CD3• signaling domain. In some embodiments, the CAR comprises a CD2 signaling domain, a CD137 (4-1BB) signaling domain, and a CD3• signaling domain. In some embodiments, the CD2 signaling domain is derived from a CD2 cytoplasmic domain. In some embodiments, the CD2 signaling domain is derived from a human CD2 cytoplasmic domain.

Editing of Target Genes in Immune Cells

In some embodiments, provided herein is an immune cell with at least one modification in an endogenous gene or regulatory elements thereof. In some embodiments, the immune cell may comprise a further modification in at least one, two, three, four, five, six, seven, eight, nine, ten, eleven, twelve, thirteen, fourteen, fifteen, sixteen, seventeen, eighteen, nineteen, twenty or more endogenous genes or regulatory elements thereof. In some embodiments, the at least one modification is a single nucleobase modification. In some embodiments, the at least one modification is by base editing. The base editing may be positioned at any suitable position of the gene, or in a regulatory element of the gene. Thus, it may be appreciated that a single base editing at a start codon, for example, can completely abolish the expression of the gene. In some embodiments, the base editing may be performed at a site within an exon. In some embodiments, the base editing may be performed at a site on more than one exons. In some embodiments, the base editing may be performed at any exon of the multiple exons in a gene. In some embodiments, base editing may introduce a premature STOP codon into an exon, resulting in either lack of a translated product or in a truncated that may be misfolded and thereby eliminated by degradation, or may produce an unstable mRNA that is readily degraded. In some embodiments, the immune cell is a T cell. In some embodiments, the immune cell is a CAR-T cell. In some embodiments, the immune cell is a NK cell.

In some embodiments, an edited gene may be an immune response regulation gene, an immunogenic gene, a checkpoint inhibitor gene, a gene involved in immune responses, a cell surface marker, e.g. a T cell surface marker, or any combination thereof. In some embodiments, the edited gene is associated with activated T cell proliferation, alpha-beta T cell activation, gamma-delta T cell activation, positive regulation of T cell proliferation, negative regulation of T-helper cell proliferation or differentiation, or their regulatory elements thereof, or combinations thereof. In some embodiments, the edited gene may be a checkpoint inhibitor gene. In some embodiments, the checkpoint inhibitor gene is, for example, a PD1 gene, a PDC1 gene, or a member related to or regulating the pathway of their formation or activation. In some embodiments, the edited gene is a TRAC gene. In some embodiments, the edited gene is a CD2 gene. In some embodiments, the edited gene is a CD3 gene. In some embodiments, the edited gene is a B2M gene. In some embodiments, the edited gene is a CIITA gene. In some embodiments, the edited gene is a TRBC1 2 gene. In some embodiments, the edited gene is a CD5 gene. In some embodiments, the edited gene is a CD7 gene. In some embodiments, the edited gene is a CD52 gene. In some embodiments, at least one gene is edited selected from PD-1, CD2, CD3, CD5, CD7, CD52, B2M, TRBC1/2, CIITA, and TRAC, or combinations thereof. In some embodiments, the PD-1. CD2, CD52, and TRAC genes are edited. In some embodiments, the PD-1, CD2, CD52. B2M, TRBC1/2, CIITA and TRAC genes are edited. In some embodiments, the PD-1, CD5, CD52, and TRAC genes are edited. In some embodiments, the PD-1, CD3, CD7, and CD52 genes are edited.

In some embodiments, the editing of the endogenous gene reduces expression of the gene. In some embodiments, the editing of the endogenous gene reduces expression of the gene by at least 50% as compared to a control cell without the modification. In some embodiments, the editing of the endogenous gene reduces expression of the gene by at least 60% as compared to a control cell without the modification. In some embodiments, the editing of the endogenous gene reduces expression of the gene by at least 70% as compared to a control cell without the modification. In some embodiments, the editing of the endogenous gene reduces expression of the gene by at least 80% as compared to a control cell without the modification. In some embodiments, the editing of the endogenous gene reduces expression of the gene by at least 90% as compared to a control cell without the modification. In some embodiments, the editing of the endogenous gene reduces expression of the gene by at least 100% as compared to a control cell without the modification. In some embodiments, the editing of the endogenous gene eliminates gene expression.

In some embodiments, base editing may be performed, for example on exon 1, exon 2, or exon 3, or exon 4, or exon 5 of human CD2 gene. In some embodiments, base editing in the human CD2 gene is performed at a site within exon 1. In some embodiments, base editing in the human CD2 gene is performed at a site within exon 2. In some embodiments, base editing in the human CD2 gene is performed at a site within exon 3. In some embodiments, base editing in the human CD2 gene is performed at a site within exon 4. In some embodiments, base editing in the human CD2 gene is performed at a site within exon 5. In some embodiments one or more base editing actions can be performed on the human CD2 gene, at exon 1, exon 2, exon 3, exon 4, exon 5, or any combination thereof.

In some embodiments, base editing in the human CD2 gene is performed by editing position 8 of a guide RNA spacer sequence targeting exon 2. In some embodiments, base editing in the human CD2 gene is performed by editing position 4 of a guide RNA spacer sequence targeting exon 3. In some embodiments, base editing in the human CD2 gene is performed by editing position 6 of a guide RNA spacer sequence targeting exon 3. In some embodiments, base editing in the human CD2 gene is performed by editing position 7 of a guide RNA spacer sequence targeting exon 3. In some embodiments, base editing in the human CD2 gene is performed by editing position 9 of a guide RNA spacer sequence targeting exon 3. In some embodiments, base editing in the human CD2 gene is performed by editing position 4 of a guide RNA spacer sequence targeting exon 4. In some embodiments, base editing in the human CD2 gene is performed by editing position 5 of a guide RNA spacer sequence targeting exon 4. In some embodiments, base editing in the human CD2 gene is performed by editing position 4 of a guide RNA spacer sequence targeting exon 5.

In some embodiments, base editing may be performed, for example on exon 1, exon 2, or exon 3, or exon 4, or exon 5 of human PDC1/PD-1 gene. In some embodiments, base editing in the human PDC1/PD-1 gene is performed at a site within exon 1. In some embodiments, base editing in the human PDC1/PD-1 gene is performed at a site within exon 2. In some embodiments, base editing in the human PDC1/PD-1 gene is performed at a site within exon 3. In some embodiments, base editing in the human PDC1/PD-1 gene is performed at a site within exon 4. In some embodiments, base editing in the human PDC1/PD-1 gene is performed at a site within exon 5. In some embodiments one or more base editing actions can be performed on the human PDC1/PD-1 gene, at exon 1, exon 2, exon 3, exon 4, exon 5, or any combination thereof.

In some embodiments, base editing in the human PDC1/PD-1A gene is performed by editing position 4, 6, 7, 8 or 9 of a guide RNA spacer sequence targeting exon 1. In some embodiments, base editing in the human PDC1 PD-1A gene is performed by editing position 4, 6, 7, 8 or 9 of a guide RNA spacer sequence targeting exon 1. In some embodiments, base editing in the human PDC1 PD-1A gene is performed by editing position 7, 8 or 9 of a guide RNA spacer sequence targeting exon 2. In some embodiments, base editing in the human PDC1/PD-1A gene is performed by editing position 5, 7, or 8 of a guide RNA spacer sequence targeting exon 3. In some embodiments, base editing in the human PDC1 PD-1A gene is performed by editing position 5 or 8 of a guide RNA spacer sequence targeting exon 5.

In some embodiments, base editing may be performed, for example on exon 1, exon 2, or exon 3 of human CD7 gene. In some embodiments, base editing in the human CD7 gene is performed at a site within exon 1. In some embodiments, base editing in the human CD7 gene is performed at a site within exon 2. In some embodiments, base editing in the human CD7 gene is performed at a site within exon 3. In some embodiments one or more base editing actions can be performed on the human CD7 gene, at exon 1, exon 2, exon 3, or any combination thereof. In some embodiments, base editing in the human CD7 gene is performed at position 4, 8, 9 within exon 1. In some embodiments, base editing in the human CD7 gene is performed by editing position 5, 6, 7, 8, or 9 of a guide RNA spacer sequence targeting exon 2. In some embodiments, base editing in the human CD7 gene is performed by editing position 4 or 9 of a guide RNA spacer sequence targeting exon 3.

In some embodiments, base editing may be performed, for example on exon 1, exon 2, or exon 3 of human CD52 gene. In some embodiments, base editing in the human CD52 gene is performed at a site within exon 1. In some embodiments, base editing in the human CD52 gene is performed at a site within exon 2. In some embodiments, base editing in the human CD7 gene is performed at a site within exon 3. In some embodiments one or more base editing actions can be performed on the human CD52 gene, at exon 1, exon 2, exon 3, or any combination thereof. In some embodiments, base editing in the human CD52 gene is performed by editing position 4 or 7 of a guide RNA spacer sequence targeting exon 1. In some embodiments, base editing in the human CD52 gene is performed by editing position 5, 6, or 7 of a guide RNA spacer sequence targeting exon 2.

In some embodiments, base editing may be performed, for example on exon 1, exon 2, or exon 3, or exon 4, or exon 5, or exon 6, or exon 7, or exon 8, or exon 9, or exon 10 of human CD5 gene. In some embodiments, base editing in the human CD5 gene is performed at a site within exon 1. In some embodiments, base editing in the human CD5 gene is performed at a site within exon 2. In some embodiments, base editing in the human CD5 gene is performed at a site within exon 3. In some embodiments, base editing in the human CD5 gene is performed at a site within exon 4. In some embodiments, base editing in the human CD5 gene is performed at a site within exon 5. In some embodiments, base editing in the human CD5 gene is performed at a site within exon 6. In some embodiments, base editing in the human CD5 gene is performed at a site within exon 7. In some embodiments, base editing in the human CD5 gene is performed at a site within exon 8. In some embodiments, base editing in the human CD5 gene is performed at a site within exon 9. In some embodiments, base editing in the human CD5 gene is performed at a site within exon 10. In some embodiments one or more base editing actions can be performed on the human CD5 gene, at exon 1, exon 2, exon 3, exon 4, exon 5, exon 6, exon 7, exon 8, exon 9, exon 10, or any combination thereof.

In some embodiments, base editing in the human CD5 gene is performed by editing position 6 of a guide RNA spacer sequence targeting exon 1. In some embodiments, base editing in the human CD5 gene is performed by editing position 6 of a guide RNA spacer sequence targeting exon 1. In some embodiments, base editing in the human CD5 gene is performed by editing position 5 and/or 6 of a guide RNA spacer sequence targeting exon 2. In some embodiments, base editing in the human CD5 gene is performed by editing position 5 and/or 6 of a guide RNA spacer sequence targeting exon 2. In some embodiments, base editing in the human CD5 gene is performed by editing position 5, 6, 8 and/or 9 of a guide RNA spacer sequence targeting exon 3. In some embodiments, base editing in the human CD5 gene is performed by editing position 4 or 5 of a guide RNA spacer sequence targeting exon 4. In some embodiments, base editing in the human CD5 gene is performed by editing position 4, 5, 7, 8 or 9 of a guide RNA spacer sequence targeting exon 5. In some embodiments, base editing in the human CD5 gene is performed by editing position 4, 5, 6, 7, 8 and/or 9 of a guide RNA spacer sequence targeting exon 6. In some embodiments, base editing in the human CD5 gene is performed by editing position 4 of a guide RNA spacer sequence targeting exon 7. In some embodiments, base editing in the human CD5 gene is performed by editing position 4, 5, or 7 of a guide RNA spacer sequence targeting exon 8. In some embodiments, base editing in the human CD5 gene is performed by editing position 6 or 8 of a guide RNA spacer sequence targeting exon 9. In some embodiments, base editing in the human CD5 gene is performed by editing position 9 of a guide RNA spacer sequence targeting exon 10.

In some embodiments, base editing may be performed, for example on exon 1, or exon 2, or exon 3 or exon 4 of human TRAC gene (UCSC genomic database ENSG00000277734.8). In some embodiments, base editing in human TRAC gene is performed at a site within exon 1. In some embodiments, base editing in human TRAC gene is performed at a site within exon 2. In some embodiments, base editing in human TRAC gene is performed at a site within exon 3. In some embodiments, base editing in human TRAC gene is performed at a site within exon 4. In some embodiments one or more base editing actions can be performed on human TRAC gene, at exon 1, exon 2, exon 3, exon 4 or any combination thereof. In some embodiments, base editing in the human TRAC gene is performed by editing at position 5, 6, or 9 of a guide RNA spacer sequence targeting within exon 1.

In some embodiments, base editing may be performed, for example, on exon 1, exon 2, exon 3, or exon 4 of human B2M gene (Chromosome 15, NC_000015.10, 44711492-44718877; exemplary mRNA sequence NM_004048). In some embodiments, base editing in human B2M gene is performed at a site within exon 1. In some embodiments, base editing in human B2M gene is performed at a site within exon 2. In some embodiments, base editing in human B2M gene is performed at a site within exon 3. In some embodiments, base editing in human B2M gene is performed at a site within exon 4. In some embodiments one or more base editing actions can be performed on human B2M gene, at exon 1, exon 2, exon 3, exon 4 or any combination thereof. In some embodiments, base editing in the human B2M gene is performed by editing position 5 of a guide RNA spacer sequence targeting exon 1. In some embodiments, base editing in the human B2M gene is performed by editing position 4, 6 or 9 of a guide RNA spacer sequence targeting exon 2.

In some embodiments, base editing may be performed, for example on exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, or exon 19 of human CIITA gene. In some embodiments, base editing in the human CD52 gene is performed at a site within exon 1. In some embodiments, base editing in the human CIITA gene is performed at a site within exon 2. In some embodiments, base editing in the human CIITA gene is performed at a site within exon 3. In some embodiments, base editing in the human CIITA gene is performed at a site within exon 4. In some embodiments, base editing in the human CIITA gene is performed at a site within exon 5. In some embodiments, base editing in the human CIITA gene is performed at a site within exon 6. In some embodiments, base editing in the human CIITA gene is performed at a site within exon 7. In some embodiments, base editing in the human CIITA gene is performed at a site within exon 8. In some embodiments, base editing in the human CIITA gene is performed at a site within exon 9. In some embodiments, base editing in the human CIITA gene is performed at a site within exon 10. In some embodiments, base editing in the human CIITA gene is performed at a site within exon 11. In some embodiments, base editing in the human CIITA gene is performed at a site within exon 12. In some embodiments, base editing in the human CIITA gene is performed at a site within exon 13. In some embodiments, base editing in the human CIITA gene is performed at a site within exon 14. In some embodiments, base editing in the human CIITA gene is performed at a site within exon 15. In some embodiments, base editing in the human CIITA gene is performed at a site within exon 16. In some embodiments, base editing in the human CIITA gene is performed at a site within exon 17. In some embodiments, base editing in the human CIITA gene is performed at a site within exon 18. In some embodiments, base editing in the human CIITA gene is performed at a site within exon 19. In some embodiments one or more base editing actions can be performed on the human CIITA gene, at exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, or any combination thereof.

In some embodiments, base editing in the human CIITA gene is performed by editing position 6 or 7 of a guide RNA spacer sequence targeting exon 1. In some embodiments, base editing in the human CIITA gene is performed by editing position 7 or 8 of a guide RNA spacer sequence targeting exon 2. In some embodiments, base editing in the human CIITA gene is performed by editing position 8 of a guide RNA spacer sequence targeting exon 4. In some embodiments, base editing in the human CIITA gene is performed by editing position 4, 7 or 8 of a guide RNA spacer sequence targeting exon 7. In some embodiments, base editing in the human CIITA gene is performed by editing position 8 of a guide RNA spacer sequence targeting exon 8. In some embodiments, base editing in the human CIITA gene is performed by editing position 4, 6, or 7 of a guide RNA spacer sequence targeting exon 9. In some embodiments, base editing in the human CIITA gene is performed by editing position 4, 5, or 7 of a guide RNA spacer sequence targeting exon 10. In some embodiments, base editing in the human CIITA gene is performed by editing position 4, 5, 6, 7 or 8 of a guide RNA spacer sequence targeting exon 11. In some embodiments, base editing in the human CIITA gene is performed by editing position 6 of a guide RNA spacer sequence targeting exon 12. In some embodiments, base editing in the human CIITA gene is performed by editing position 4 or 5 of a guide RNA spacer sequence targeting exon 14. In some embodiments, base editing in the human CIITA gene is performed by editing position 4, 7 or 8 of a guide RNA spacer sequence targeting exon 15. In some embodiments, base editing in the human CIITA gene is performed by editing position 5, 7 or 8 of a guide RNA spacer sequence targeting exon 16. In some embodiments, base editing in the human CIITA gene is performed by editing position 7 or 8 of a guide RNA spacer sequence targeting exon 17. In some embodiments, base editing in the human CIITA gene is performed by editing position 5 of a guide RNA spacer sequence targeting exon 18. In some embodiments, base editing in the human CIITA gene is performed by editing position 5, 6, 7 or 8 of a guide RNA spacer sequence targeting exon 19.

In some embodiments, base editing may be performed, for example, on exon 1, exon 2, or exon 3 of human TRBC1 gene. In some embodiments, base editing in human TRBC1 gene is performed at a site within exon 1. In some embodiments, base editing in human TRBC1 gene is performed at a site within exon 2. In some embodiments, base editing in human TRBC1 gene is performed at a site within exon 3. In some embodiments one or more base editing actions can be performed on human TRBC1 gene, at exon 1, exon 2, exon 3, or any combination thereof. In some embodiments, base editing in the human TRBC1 gene is performed by editing position 5, 6, 7 or 8 of a guide RNA spacer sequence targeting exon 1. In some embodiments, base editing in the human TRBC1 gene is performed by editing position 8 of a guide RNA spacer sequence targeting exon 2. In some embodiments, base editing in the human TRBC1 gene is performed by editing position 4 or 5 of a guide RNA spacer sequence targeting exon 3.

In some embodiments, base editing may be performed, for example, on exon 1, exon 2, or exon 3 of human TRBC2 gene. In some embodiments, base editing in human TRBC2 gene is performed at a site within exon 1. In some embodiments, base editing in human TRBC2 gene is performed at a site within exon 2. In some embodiments, base editing in human TRBC2 gene is performed at a site within exon 3. In some embodiments one or more base editing actions can be performed on human TRBC2 gene, at exon 1, exon 2, exon 3, or any combination thereof. In some embodiments, base editing in the human TRBC2 gene is performed by editing position 5, 6, 7 or 8 of a guide RNA spacer sequence targeting exon 1. In some embodiments, base editing in the human TRBC2 gene is performed by editing position 7 or 8 of a guide RNA spacer sequence targeting exon 2. In some embodiments, base editing in the human TRBC2 gene is performed by editing position 4 of a guide RNA spacer sequence targeting exon 3.

In some embodiments, base editing may be performed on an intron. For example, base editing may be performed on an intron. In some embodiments, the base editing may be performed at a site within an intron. In some embodiments, the base editing may be performed at a site one or more introns. In some embodiments, the base editing may be performed at any exon of the multiple introns in a gene. In some embodiments, one or more base editing may be performed on an exon, an intron or any combination of exons and introns.

In some embodiments, the modification or base edit may be within a promoter site. In some embodiments, the base edit may be introduced within an alternative promoter site. In some embodiments, the base edit may be in a 5' regulatory element, such as an enhancer. In some embodiment, base editing may be introduced to disrupt the binding site of a nucleic acid binding protein. Exemplary nucleic acid binding proteins may be a polymerase, nuclease, gyrase, topoisomerase, methylase or methyl transferase, transcription factors, enhancer, PABP, zinc finger proteins, among many others.

In some embodiments, base editing may be used for splice disruption to silence target protein expression. In some embodiments, base editing may generate a splice acceptor-splice donor (SA-SD) site. Targeted base editing generating a SA-SD, or at a SA-SD site can result in reduced expression of a gene. In some embodiments, base editors (e.g., ABE, CBE) are used to target dinucleotide motifs that constitute splice acceptor and splice donor sites, which are the first and last two nucleotides of each intron. For example, the exon 3 splice donor (SD) site of CD2 may be targeted for base editing. In some embodiments, splice disruption is achieved with an adenosine base editor (ABE). In some embodiments, splice disruption is achieved with a cytidine base editor (CBE). In some embodiments, base editors (e.g., ABE, CBE) are used to edit exons by creating STOP codons.

In some embodiments, provided herein is an immune cell with at least one modification in one or more endogenous genes. In some embodiments, the immune cell may have at least one modification in one, two, three, four, five, six, seven, eight, nine, ten, eleven, twelve, thirteen, fourteen, fifteen, sixteen, seventeen, eighteen, nineteen, twenty or more endogenous genes. In some embodiments, the modification generates a premature stop codon in the endogenous genes. In some embodiments, the STOP codon silences target protein expression. In some embodiments, the modification is a single base modification. In some embodiments, the modification is generated by base editing. The premature stop codon may be generated in an exon, an intron, or an untranslated region. In some embodiments, base editing may be used to introduce more than one STOP codon, in one or more alternative reading frames. For example, a premature STOP codon can be introduced at position 8 within exon 2, at position 4 within exon 3, at position 6 within exon 3, at position 9 within exon 3, at position 4 within exon 4, at position 5 within exon 4, or at position 4 within exon 5. In some embodiments, the stop codon is generated by a adenosine base editor (ABE). In some embodiments, the stop codon is generated by a cytidine base editor (CBE). In some embodiments, the CBE generates any one of the following edits (shown in underlined font) to generate a STOP codon: CAG→TAG; CAA→TAA; CGA→TGA; TGG→TGA; TGG→TAG; or TGG→TAA.

In some embodiments, modification/base edits may be introduced at a 3'-UTR, for example, in a poly adenylation (poly-A) site. In some embodiments, base editing may be performed on a 5'-UTR region.

Delivery System

The suitability of nucleobase editors to target one or more nucleotides in a gene (e.g., CD2) is evaluated as described herein. In one embodiment, a single cell of interest is transfected, transduced, or otherwise modified with a nucleic acid molecule or molecules encoding a base editing system described herein together with a small amount of a vector encoding a reporter (e.g., GFP). These cells can be any cell line known in the art, including immune cells (e.g., T- or NK-cells), or immortalized human cell lines, such as 293T, K562 or U20S. Alternatively, primary cells (e.g., human) may be used. Cells may also be obtained from a subject or individual, such as from tissue biopsy, surgery, blood, plasma, serum, or other biological fluid. Such cells may be relevant to the eventual cell target.

Delivery may be performed using a viral vector. In one embodiment, transfection may be performed using lipid transfection (such as Lipofectamine or Fugene) or by electroporation. Following transfection, expression of a reporter (e.g., GFP) can be determined either by fluorescence microscopy or by flow cytometry to confirm consistent and high levels of transfection. These preliminary transfections can comprise different nucleobase editors to determine which combinations of editors give the greatest activity. The system can comprise one or more different vectors. In one embodiment, the base editor is codon optimized for expression of the desired cell type, preferentially a eukaryotic cell, preferably a mammalian cell or a human cell.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing (NGS) techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). The fusion proteins that induce the greatest levels of target specific alterations in initial tests can be selected for further evaluation.

In particular embodiments, the nucleobase editors are used to target polynucleotides of interest. In one embodiment, a nucleobase editor of the invention is delivered to cells (e.g., immune cells (e.g., T- or NK-cells)) in conjunction with one or more guide RNAs that are used to target one or more nucleic acid sequences of interest within the genome of a cell, thereby altering the target gene(s) (e.g., a CD2). In some embodiments, a base editor is targeted by one or more guide RNAs to introduce one or more edits to the sequence of one or more genes of interest (e.g., CD2, TRAC, B2M, CIITA, TRBC1, TRBC2, PD-1, CD52). In some embodiments, the one or more edits to the sequence of one or more genes of interest decrease or eliminate expression of the protein encoded by the gene in the host cell (e.g., immune cells (e.g., T- or NK-cells)). In some embodiments, expression of one or more proteins encoded by one or more genes of interest (e.g., CD2) is completely knocked out or eliminated in the host cell (e.g., immune cells (e.g., T- or NK-cells)).

In some embodiments, the host cell is a mammalian cell. In some embodiments, the host cell is a human cell. In some embodiments, the host cell is an immune cell. In some embodiments, the immune cell is a T cell. In some embodiments, the immune cell is a NK cell. In some embodiments, the one or more edits are introduced into one or more genes selected from CD2, CD3, CD5, CD7, CD52, B2M, CIITA, TRBC1, TRBC2, TRAC, and PD-1, or combinations thereof. In some embodiments, the one or more edits are introduced into the CD2 gene. In some embodiments, the one or more edits are introduced into the CD5 gene. In some embodiments, the one or more edits are introduced into the CD7 gene. In some embodiments, the one or more edits are introduced into the CD2, CD52, TRAC, and PD-1 genes. In some embodiments, the one or more edits are introduced into the CD5, CD52, TRAC, and PD-1 genes. In some embodiments, the one or more edits are introduced into the CD7, CD3, CD52, and PD-1 genes.

Nucleic Acid-Based Delivery of Base Editor Systems

Nucleic acid molecules encoding a base editor system according to the present disclosure can be administered to subjects or delivered into cells in vitro or in vivo by art-known methods or as described herein. For example, a base editor system comprising a deaminase (e.g., cytidine or adenine deaminase) can be delivered by vectors (e.g., viral or non-viral vectors), or by naked DNA, DNA complexes, lipid nanoparticles, or a combination of the aforementioned compositions.

Nanoparticles, which can be organic or inorganic, are useful for delivering a base editor system or component thereof. Nanoparticles are well known in the art and any suitable nanoparticle can be used to deliver a base editor system or component thereof, or a nucleic acid molecule encoding such components. In one example, organic (e.g. lipid and/or polymer) nanoparticles are suitable for use as delivery vehicles in certain embodiments of this disclosure. Exemplary lipids for use in nanoparticle formulations, and/or gene transfer are shown in Table 17 (below).

TABLE 17

Lipids used for gene transfer.
Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3•-[N-(N',N'-Dimethylaminoethane)-carbamoyl]cholesterol | DC-Chol | Cationic |
| Bis-guanidium-tron-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadeceny]-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 18 lists exemplary polymers for use in gene transfer and/or nanoparticle formulations.

TABLE 18

Polymers used for gene transfer.
Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(•-aminoester) | |
| Poly(4-hydroxy-L-proline ester) | PHP |
| Poly(allylamine) | |

TABLE 18-continued

| Polymers used for gene transfer. Polymers Used for Gene Transfer | |
|---|---|
| Polymer | Abbreviation |
| Poly(•-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 19 summarizes delivery methods for a polynucleotide encoding a fusion protein described herein.

TABLE 19

| Delivery methods. | | | | | |
|---|---|---|---|---|---|
| Delivery | Vector/Mode | Delivery into Non-Dividing Cells | Duration of Expression | Genome Integration | Type of Molecule Delivered |
| Physical | (e.g., electroporation, particle gun, Calcium Phosphate transfection | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

In another aspect, the delivery of base editor system components or nucleic acids encoding such components, for example, a polynucleotide programmable nucleotide binding domain (e.g., Cas9) such as, for example, Cas9 or variants thereof, and a gRNA targeting a nucleic acid sequence of interest, may be accomplished by delivering the ribonucleoprotein (RNP) to cells. The RNP comprises a polynucleotide programmable nucleotide binding domain (e.g., Cas9), in complex with the targeting gRNA. RNPs or polynucleotides described herein may be delivered to cells using known methods, such as electroporation, nucleofection, or cationic lipid-mediated methods, for example, as reported by Zuris, J. A. et al., 2015, Nat. Biotechnology, 33 (1): 73-80, which is incorporated by reference in its entirety. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

Nucleic acid molecules encoding a base editor system can be delivered directly to cells (e.g., immune cells, such as NK or T cells) as naked DNA or RNA by means of transfection or electroporation, for example, or can be conjugated to molecules (e.g., N-acetylgalactosamine) promoting uptake by the target cells. Vectors encoding base editor systems and/or their components can also be used. In particular embodiments, a polynucleotide, e.g. a mRNA encoding a base editor system or a functional component thereof, may be co-electroporated with one or more guide RNAs as described herein.

Nucleic acid vectors can comprise one or more sequences encoding a domain of a fusion protein described herein. A vector can also encode a protein component of a base editor system operably linked to a nuclear localization signal, nucleolar localization signal, or mitochondrial localization signal. As one example, a vector can include a Cas9 coding sequence that includes one or more nuclear localization sequences (e.g., a nuclear localization sequence from SV40), and one or more deaminases.

The vector can also include any suitable number of regulatory/control elements, e.g., promoters, enhancers, introns, polyadenylation signals, Kozak consensus sequences, or internal ribosome entry sites (IRES). These elements are well known in the art.

Vectors according to this disclosure include recombinant viral vectors. Exemplary viral vectors are set forth herein above Other viral vectors known in the art can also be used. In addition, viral particles can be used to deliver base editor system components in nucleic acid and/or protein form. For example, "empty" viral particles can be assembled to contain a base editor system or component as cargo. Viral vectors and viral particles can also be engineered to incorporate targeting ligands to alter target tissue specificity.

Vectors described herein may comprise regulatory elements to drive expression of a base editor system or component thereof. Such vectors include adeno-associated viruses with inverted long terminal repeats (AAV ITR). The use of AAV-ITR can be advantageous for eliminating the need for an additional promoter element, which can take up space in the vector. The additional space freed up can be used to drive the expression of additional elements, such as a guide nucleic acid or a selectable marker. ITR activity can be used to reduce potential toxicity due to over expression.

Any suitable promoter can be used to drive expression of a base editor system or component thereof and, where appropriate, the guide nucleic acid. For ubiquitous expression, promoters include CMV, CAG, CBh, PGK, SV40, Ferritin heavy or light chains. For brain or other CNS cell expression, suitable promoters include: SynapsinI for all neurons, CaMKIIalpha for excitatory neurons, GAD67 or GAD65 or VGAT for GABAergic neurons. For liver cell expression, suitable promoters include the Albumin promoter. For lung cell expression, suitable promoters include SP-B. For endothelial cells, suitable promoters include ICAM. For hematopoietic cell expression suitable promoters include IFNbeta or CD45. For osteoblast expression suitable promoters can include OG-2.

In some embodiments, a base editor system of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters, such as U6 or H1 Use of Pol II promoter and intronic cassettes to express gRNA Adeno Associated Virus (AAV).

In particular embodiments, a fusion protein of the invention is encoded by a polynucleotide present in a viral vector (e.g., adeno-associated virus (AAV), AAV3, AAV3b, AAV4, AAV5, AAV6, AAV7, AAV8, AAV9, AAVrh8, AAV10, and variants thereof), or a suitable capsid protein of any viral vector. Thus, in some aspects, the disclosure relates to the viral delivery of a fusion protein. Examples of viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2).

In some aspects, the methods described herein for editing specific genes in a cell can be used to genetically modify the cell.

In some aspects, the methods described herein for editing specific genes in an immune cell can be used to genetically modify a CAR-T cell. Such CAR-T cells, and methods to produce such CAR-T cells are described in International Application Nos. PCT/US2016/060736, PCT/US2016/060734, PCT/US2016/034873, PCT/US2015/040660, PCT/EP2016/055332, PCT/IB2015/058650, PCT/EP2015/067441, PCT/EP2014/078876, PCT/EP2014/059662, PCT/IB2014/061409, PCT/US2016/019192, PCT/US2015/059106, PCT/US2016/052260, PCT/US2015/020606, PCT/US2015/055764, PCT/CN2014/094393, PCT/US2017/059989, PCT/US2017/027606, and PCT/US2015/064269, the contents of each is hereby incorporated in its entirety.

Viral Vectors

A base editor described herein can be delivered with a viral vector. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other embodiments, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat.

No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176.58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, Adeno-associated virus ("AAV") vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. AAV vectors can also be used to transduce cells with target nucleic acids, e.g., in the in vitro production of nucleic acids and peptides, and for in vivo and ex vivo gene therapy procedures (See, e.g., West et al., Virology 160:38-47 (1987), U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

In some embodiments, AAV vectors are used to transduce a cell of interest with a polynucleotide encoding a base editor or base editor system as provided herein. AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs).

This means disclosed base editor as well as a promoter and transcription terminator can fit into a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells, and one can select AAV4 for targeting cardiac tissue. AAV8 is useful for delivery to the liver. A tabulation of certain AAV serotypes as to these cells can be found in Grimm, D et al, J. Virol. 82:5887-5911 (2008)).

In some embodiments, lentiviral vectors are used to transduce a cell of interest with a polynucleotide encoding a base editor or base editor system as provided herein. Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OptiMEM (serum-free) media and transfection was done 4 hours later. Cells are transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection can be done in 4 mL OptiMEM with a cationic lipid delivery agent (50 μl Lipofectamine 2000 and 100 μl Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 μm low protein binding (PVDF) filter. They are then spun in an ultracentrifuge for 2 hours at 24,000 rpm. Viral pellets are resuspended in 50 μl of DMEM overnight at 4• C. They are then aliquoted and immediately frozen at −80•C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors are contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GCCACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289 (21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two separate halves (5• and 3• ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5• and 3• genomes (dual AAV overlapping vectors); (2) ITR-mediated tail-to-head concatemerization of 5• and 3• genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

Inteins (intervening protein) are auto-processing domains found in a variety of diverse organisms, which carry out a process known as protein splicing. Protein splicing is a multi-step biochemical reaction comprised of both the cleavage and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio) esterification by nucleophilic attack of the first C-extein residue (+1), which is a cysteine, serine, or threonine. The resulting branched (thio) ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, an N-terminal fragment of a base editor (e.g., ABE, CBE) is fused to a split intein-N and a C-terminal fragment is fused to a split intein-C. These fragments are then packaged into two or more AAV vectors. In some embodiments, the N-terminus of an intein is fused to the C-terminus of a fusion protein and the C-terminus of the intein is fused to the N-terminus of an AAV capsid protein.

In one embodiment, inteins are utilized to join fragments or portions of a cytidine or adenosine base editor protein that is grafted onto an AAV capsid protein. The use of certain inteins for joining heterologous protein fragments is described, for example, in Wood et al., J. Biol. Chem. 289 (21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis.

The N-terminus of each fragment is fused to an intein-N and the C-terminus of each fragment is fused to an intein C at amino acid positions S303, T310, T313, S355, A456, S460, A463, T466, S469, T472, T474, C574, S577, A589, and S590, which are indicated in capital letters in the sequence below (called the "Cas9 reference sequence").

(SEQ ID NO: 197)

1 mdkkysigld igtnsvgwav itdeykvpsk kfkvlgntdr hsikknliga llfdsgetae 61 atrlkrtarr rytrrknric ylqeifsnem akvddsffhr leesflveed kkherhpifg 121 nivdevayhe kyptiyhlrk klvdstdkad lrliylalah mikfrghfli egdlnpdnsd 181 vdklfiqlvq tynqlfeenp inasgvdaka ilsarlsksr rlenliaqlp gekknglfgn 241 lialslgltp nfksnfdlae daklqlskdt ydddldnlla qigdqyadlf laaknlsdai 301 llSdilrvnT eiTkaplsas mikrydehhq dltllkalvr qqlpekykei ffdqSkngya 361 gyidggasqe efykfikpil ekmdgteell vklnredllr kqrtfdngsi phqihlgelh 421 ailrrqedfy pflkdnreki ekiltfripy yvgplArgnS rfAwmTrkSe eTiTpwnfee 481 vvdkgasaqs fiermtnfdk nlpnekvlpk hsllyeyftv yneltkvkyv tegmrkpafl 541 sgeqkkaivd llfktnrkvt vkqlkedyfk kieCfdSvei sgvedrfnAS lgtyhdllki 601 ikdkdfldne enediledív ltltlfedre mieerlktya hlfddkvmkq lkrrrytgwg 661 rlsrklingi rdkqsgktil dflksdgfan rnfmqlihdd sltfkediqk aqvsgqgdsl 721 hehianlags paikkgilqt vkvvdelvkv mgrhkpeniv iemarenqtt qkgqknsrer 781 mkrieegike lgsqilkehp ventqlqnek lylyylqngr dmyvdqeldi nrlsdydvdh 841 ivpqsflkdd sidnkvltrs dknrgksdnv pseevvkkmk nywrqllnak litqrkfdnl -continued

```
 901  tkaergglse ldkagfikrq lvetrqitkh vaqildsrmn tkydendkli revkvitlks
 961  klvsdfrkdf qfykvreinn yhhahdayln avvgtalikk ypklesefvy gdykvydvrk
1021  miakseqeig katakyffys nimnffktei tlangeirkr plietngetg eivwdkgrdf
1081  atvrkvlsmp qvnivkktev qtggfskesi lpkrnsdkli arkkdwdpkk yggfdsptva
1141  ysvlvvakve kgkskklksv kellgitime rssfeknpid fleakgykev kkdliiklpk
1201  yslfelengr krmlasagel qkgnelalps kyvnflylas hyeklkgspe dneqkqlfve
1261  qhkhyldeii eqisefskrv iladanldkv lsaynkhrdk pireqaenii hlftltnlga
1321  paafkyfdtt idrkrytstk evldatlihq sitglyetri dlsqlggd
```

Pharmaceutical Compositions

In some aspects, the present invention provides a pharmaceutical composition comprising any of the genetically modified immune cells, base editors, fusion proteins, or the fusion protein-guide polynucleotide complexes described herein. More specifically, provided herein are pharmaceutical compositions comprising a genetically modified immune cell, or a population of such immune cells, expressing a chimeric antigen receptor (CAR), wherein said modified immune cell, or a population thereof, has at least one edited gene to provide fratricide resistance, enhance the function of the modified immune cell, or to reduce immunosuppression or inhibition of the modified immune cell, wherein expression of the edited gene is either knocked out or knocked down. In some embodiments, the at least one edited gene is CD2, CD3 CD5, CD7, CD52, B2M, CIITA, TRBC1, TRBC2, TRAC, PD-1, or combinations thereof. In some embodiments, CD2, CD5, or CD7 is edited. In some embodiments, CD2, CD6, or CD7 is edited in combination with one or more genes selected from CD3, CD52, TRAC, and/or PD-1.

The present invention also provides methods for enriching a population of modified immune cells. In some embodiments, a method for enriching a population of modified immune cells includes administering an anti-CD2 CAR to kill a cell in the population of modified immune cells that does not have an inactivated CD2 gene. In some embodiments, a method for enriching a population of modified immune cells includes removing from the population of modified immune cells a cell expressing •/• T-cell receptor (TCR••). In some embodiment, TCR••+ cells are removed using a TCR••depletion column. In some embodiments, cells expressing CD2 and TCR•• are removed from the population of modified immune cells to enrich the population. In some embodiments, the population of modified immune cells is enriched prior to administration to a subject. In some embodiments, the pharmaceutical compositions of the present invention comprise an enriched population of modified immune cells.

The pharmaceutical compositions of the present invention can be prepared in accordance with known techniques. See, e.g., Remington, The Science And Practice of Pharmacy (21st ed. 2005). In general, the immune cell, or population thereof is admixed with a suitable carrier prior to administration or storage, and in some embodiments, the pharmaceutical composition further comprises a pharmaceutically acceptable carrier. Suitable pharmaceutically acceptable carriers generally comprise inert substances that aid in administering the pharmaceutical composition to a subject, aid in processing the pharmaceutical compositions into deliverable preparations, or aid in storing the pharmaceutical composition prior to administration. Pharmaceutically acceptable carriers can include agents that can stabilize, optimize or otherwise alter the form, consistency, viscosity, pH, pharmacokinetics, solubility of the formulation. Such agents include buffering agents, wetting agents, emulsifying agents, diluents, encapsulating agents, and skin penetration enhancers. For example, carriers can include, but are not limited to, saline, buffered saline, dextrose, arginine, sucrose, water, glycerol, ethanol, sorbitol, dextran, sodium carboxymethyl cellulose, and combinations thereof.

Some nonlimiting examples of materials which can serve as pharmaceutically-acceptable carriers include: (1) sugars, such as lactose, glucose and sucrose; (2) starches, such as corn starch and potato starch, (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In addition to the modified immune cell, or population thereof, and the carrier, the pharmaceutical compositions of the present invention can include at least one additional therapeutic agent useful in the treatment of disease. In some embodiments, the at least one additional therapeutic agent is one or more additional modified immune cells, or one or more populations of modified immune cells thereof. In some embodiments, the one or more additional modified immune effector cells comprise at least one edited gene to knockout or knockdown expression of the edited gene. In some embodiments, the at least one edited gene is CD2, CD3 CD5, CD7, CD52, B2M, CIITA, TRBC1, TRBC2, TRAC, PD-1, or combinations thereof. In some embodiments, CD2, CD5, or CD7 is edited. In some embodiments, CD2, CD6, or CD7 is edited in combination with one or more genes selected from CD3, CD52, TRAC, B2M, CIITA, TRBC1, TRBC2, and/or PD-1.

In some embodiments, the pharmaceutical composition comprises a modified immune effector cell (e.g., CAR-T cell) that lacks or has reduced levels of CD2 and expresses a CD2 chimeric antigen receptor containing a CD2 co-stimulatory domain and a modified immune effector cell (e.g., CAR-T cell) that lacks or has reduced levels of CD5 and expresses a CD5 chimeric antigen receptor. In some embodiments, the CD2 and/or the CD5 modified immune effector cell (e.g., CAR-T cell) contains one or more edited genes selected from CD3, CD52, TRAC, PD-1, or any combination thereof. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD2 and expresses a CD2 chimeric antigen receptor containing a CD2 co-stimulatory domain and an effective amount of a modified immune effector cell (e.g., CAR-T cell) that lacks or has reduced levels of CD7. In some embodiments, the CD2 and/or the CD7 modified immune effector cell (e.g., CAR-T cell) contains one or more edited genes selected from CD3, CD52, TRAC, PD-1, or any combination thereof. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD2 and expresses a CD2 chimeric antigen receptor containing a CD2 co-stimulatory domain, an effective amount of a modified immune effector cell (e.g., CAR-T cell) that lacks or has reduced levels of CD5, and an effective amount of a modified immune effector cell (e.g., CAR-T cell) that lacks or has reduced levels of CD7. In some embodiments, the CD2, CD5 and/or the CD7 modified immune effector cell (e.g., CAR-T cell) contains one or more edited genes selected from CD3, CD52, TRAC, PD-1, or any combination thereof.

In some embodiments, the pharmaceutical composition described herein further comprises a chemotherapeutic agent. In some embodiments, the pharmaceutical composition further comprises a cytokine peptide or a nucleic acid sequence encoding a cytokine peptide. In some embodiments, the pharmaceutical compositions comprising the modified immune cell or population thereof can be administered separately from an additional therapeutic agent.

The pharmaceutical compositions of the present invention can be used to treat any disease or condition that is responsive to autologous or allogeneic immune cell immunotherapy. For example, the pharmaceutical compositions, in some embodiments are useful in the treatment of neoplasia. In some embodiments, the neoplasia is a T- or NK-cell malignancy. In some embodiments, the T- or NK-cell malignancy is in precursor T- or NK-cells. In some embodiments, the T- or NK-cell malignancy is in mature T- or NK-cells. Nonlimiting examples of neoplasia include T-cell acute lymphoblastic leukemia (T-ALL), mycosis fungoides (MF), Sezary syndrome (SS), Peripheral T/NK•cell lymphoma, Anaplastic large cell lymphoma ALK+, Primary cutaneous T•cell lymphoma, T•cell large granular lymphocytic leukemia, Angioimmunoblastic T/NK•cell lymphoma, Hepatosplenic T•cell lymphoma, Primary cutaneous CD30+lymphoproliferative disorders, Extranodal NK/T•cell lymphoma, Adult T•cell leukemia/lymphoma, T•cell prolymphocytic leukemia, Subcutaneous panniculitis•like T-cell lymphoma, Primary cutaneous gamma-delta T-cell lymphoma, Aggressive NK•cell leukemia, and Enteropathy•associated T•cell lymphoma.

One consideration concerning the therapeutic use of genetically modified immune cells of the invention is the quantity of cells necessary to achieve an optimal or satisfactory effect. The quantity of cells to be administered may vary for the subject being treated. In one embodiment, between $10^4$ to $10^{10}$, between $10^5$ to $10^9$, or between $10^6$ and $10^8$ genetically modified immunoresponsive cells of the invention are administered to a human subject. In some embodiments, at least about $1\times10^8$, $\mathbf{2\times10^8}$, $3\times10^8$, $4\times10^8$, and $5\times10^8$ genetically modified immune cells of the invention are administered to a human subject. Determining the precise effective dose may be based on factors for each individual subject, including their size, age, sex, weight, and condition. Dosages can be readily ascertained by those skilled in the art from this disclosure and the knowledge in the art.

The skilled artisan can readily determine the number of cells and amount of optional additives, vehicles, and/or carriers in compositions and to be administered in methods of the invention. Typically, additives (in addition to the active immune cell(s)) are present in an amount of 0.001 to 50% (weight) solution in phosphate buffered saline, and the active ingredient is present in the order of micrograms to milligrams, such as about 0.0001 to about 5 wt %, preferably about 0.0001 to about 1 wt %, still more preferably about 0.0001 to about 0.05 wt % or about 0.001 to about 20 wt %, preferably about 0.01 to about 10 wt %, and still more preferably about 0.05 to about 5 wt %. Of course, for any composition to be administered to an animal or human, and for any particular method of administration, it is preferred to determine therefore: toxicity, such as by determining the lethal dose (LD) and LD50 in a suitable animal model (e.g., a rodent such as a mouse); and, the dosage of the composition(s), concentration of components therein, and the timing of administering the composition(s), which elicit a suitable response. Such determinations do not require undue experimentation from the knowledge of the skilled artisan, this disclosure and the documents cited herein. And, the time for sequential administrations can be ascertained without undue experimentation.

In one embodiment, the method and compositions described herein may be used in generating engineered T cells that express a CAR and may have one or more base edited modifications, such that the engineered T cell can mount a specific immune response against the target. The CAR may be specifically directed towards an antigen target, the antigen may be presented by a cell in a host. In some embodiments, the immune response encompasses cytotoxicity. In some embodiments, the engineered T cell has enhanced cytotoxic response against its target. In some embodiments, the engineered T cell induces an enhanced cytotoxic response against its target as compared to a non-engineered T cell. In some embodiments, the engineered T cell exhibits an enhanced cytotoxic response by at least 1.1-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold or more compared to a non-engineered cell. In some embodiments, the engineered T cell can kill at least 10%, at least 20%, at least 30%, at least 40%, at least 50%, at least 60%, at least 70%, at least 80%, at least 90%, at least 100%, at least 200%, at least 500% or at least 1000% more target cells than a non-engineered cell. In some embodiments, the T cell can induce higher memory response. In some embodiments, the T cell can induce lower levels of inflammatory cytokines than a non-engineered cell, that is, the engineered cell does not cause a cytokine storm response. In some embodiments, the engineered T cell is administered to an allogenic host, wherein the engineered T cell has no rejection by the host. In some embodiments, the allogenic T cell induces negligible or minimum rejection by the host. In some embodiments, the engineered T cell has fratricide resistance.

In some embodiments, the pharmaceutical composition is formulated for delivery to a subject. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249:1527-1533; Sefton, 1989, CRC Crit. Ref. Biomed. Eng 14.201, Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther 1999, 6:1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions.

Methods of Treatment

Some aspects of the present invention provide methods of treating a subject in need, the method comprising administering to a subject in need an effective therapeutic amount of a pharmaceutical composition as described herein. More specifically, the methods of treatment comprise administering to a subject in need thereof one or more pharmaceutical compositions comprising a population of modified immune cells expressing a chimeric receptor (CAR) and having at least one edited gene (e.g., CD2), wherein the at least one edited gene provides fratricide resistance, enhances the function, or reduces the immunosuppression or inhibition of the modified immune cell, and wherein expression of the at least one edited gene is either knocked out or knocked down. In some embodiments, the method of treatment is an autologous immune cell therapy. In other embodiments, the method of treatment is an allogeneic immune cell therapy.

In certain embodiments, the specificity of an immune cell is redirected to a marker (e.g., CD2) expressed on the surface of a diseased or altered cell in a subject by genetically modifying the immune cell to express a chimeric antigen receptor (CAR) contemplated herein. In some embodiments, the method of treatment comprises administering to a subject an immune cell as described herein, wherein the immune cell has been genetically modified to redirect its specificity to a marker (e.g., CD2) expressed on a neoplastic cell. Thus, some embodiments of the present disclosure provide a method of treating a neoplasia in a subject. In some embodiments, the neoplasia is a T- or NK-cell malignancy. In some embodiments, the T- or NK-cell malignancy is in precursor T- or NK-cells. In some embodiments, the T- or NK-cell malignancy is in mature T- or NK-cells. Nonlimiting examples of neoplasia include T-cell acute lymphoblastic leukemia (T-ALL), mycosis fungoides (MF), Sézary syndrome (SS), Peripheral T/NK•cell lymphoma, Anaplastic large cell lymphoma ALK+, Primary cutaneous T•cell lymphoma, T•cell large granular lymphocytic leukemia, Angioimmunoblastic T/NK•cell lymphoma, Hepatosplenic T•cell lymphoma, Primary cutaneous CD30+ lymphoproliferative disorders, Extranodal NK/T•cell lymphoma, Adult T• cell leukemia/lymphoma, T•cell prolymphocytic leukemia, Subcutaneous panniculitis like T-cell lymphoma, Primary cutaneous gamma•delta T-cell lymphoma, Aggressive NK•cell leukemia, and Enteropathy•associated T•cell lymphoma.

In some embodiments, the methods of treatment comprise administering to a subject having or having a propensity to develop a neoplasia (e.g., T- or NK-cell malignancy) an effective amount of a modified immune effector cell (e.g., CAR-T cell) that lacks or has reduced levels of functional T Cell Receptor Alpha Constant (TRAC), Cluster of Differentiation 2 (CD2), Cluster of Differentiation 3 (CD3), Cluster of Differentiation 5 (CD5), Cluster of Differentiation 7 (CD7), Cluster of Differentiation 52 (CD52), and/or Programmed Cell Death 1 (PD-1), Beta-2 Microglobulin (B2M), Class II, Major Histocompatibility Complex, Transactivator (CIITA), T Cell Receptor Beta Constant 1 (TRBC1), T Cell Receptor Beta Constant 2 (TRBC2), or combinations thereof. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD2 and expresses a CD2 chimeric antigen receptor containing a CD2 co-stimulatory domain. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD5 and expresses a CD5 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD7 and expresses a CD7 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of functional TRAC. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD3. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD52. In some embodiments, a subject having or having a propensity to develop a neoplasia (e.g., T- or NK-cell malignancy) is administered an effective amount of a modified immune effector cell (e.g., CAR-T cell) that lacks or has reduced levels of PD-1.

In some embodiments, a subject having or having a propensity to develop a neoplasia (e.g., T- or NK-cell malignancy) is administered an effective amount of a modified immune effector cell (e.g., CAR-T cell) that lacks or has reduced levels of CD2 and lacks or has reduced levels of TRAC, CD52, B2M, CIITA, TRBC1, TRBC2, and/or PD-1, or combinations thereof and expresses a CD2 chimeric antigen receptor containing a CD2 co-stimulatory domain. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD2, TRAC, CD52, B2M, CIITA, TRBC1, TRBC2, and PD-1 and expresses a CD2 chimeric antigen receptor containing a CD2 co-stimulatory domain. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD5 and lacks or has reduced levels of TRAC, CD52, B2M, CITA, TRBC1, TRBC2, and/or PD-1, or combinations thereof and expresses a CD5 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD5, TRAC, CD52, B2M, CIITA, TRBC1, TRBC2, and PD-1, or combinations thereof and expresses a CD5 chimeric antigen receptor In some embodiments, a subject having or having a propensity to develop a neoplasia (e.g., T- or NK-cell malignancy) is administered an effective amount of a modified immune effector cell (e.g., CAR-T cell) that lacks or has reduced levels of CD7 and lacks or has reduced levels of TRAC, CD3, CD52, B2M, CIITA, TRBC1, TRBC2, and/or PD-1, or combinations thereof and expresses a CD7 chimeric antigen receptor. In some embodiments, a subject having or having a propensity to develop a neoplasia (e.g., T- or NK-cell malignancy) is administered an effective amount of a modified immune effector cell (e.g., CAR-T cell) that lacks or has reduced levels of CD7, CD3, CD52, B2M, CIITA, TRBC1, TRBC2, and PD-1 and expresses a CD7 chimeric antigen receptor.

In some embodiments, the methods of treating a neoplasia in a subject comprise administering to the subject an immune cell as described herein and one or more additional therapeutic agents. For example, the immune cell of the present invention can be co-administered with one or more additional modified immune cells. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD2 and expresses a CD2 chimeric antigen receptor containing a CD2 co-stimulatory domain and an effective amount of a modified immune effector cell (e.g., CAR-T cell) that lacks or has reduced levels of CD5 and expresses a CD5 chimeric antigen receptor. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD2 and expresses a CD2 chimeric antigen receptor containing a CD2 co-stimulatory domain and an effective amount of a modified immune effector cell (e.g., CAR-T cell) that lacks or has reduced levels of CD7 and expresses a CD7 chimeric antigen receptor. In some embodiments, a subject having or having a propensity to develop a neoplasia (e.g., T- or NK-cell malignancy) is co-administered with an effective amount of a modified immune effector cell (e.g., CAR-T cell) that lacks or has reduced levels of CD2 and expresses a CD2 chimeric antigen receptor containing a CD2 co-stimulatory domain, an effective amount of a modified immune effector cell (e.g., CAR-T cell) that lacks or has reduced levels of CD5 and expresses a CD5 chimeric antigen receptor, and an effective amount of a modified immune effector cell (e.g., CAR-T cell) that lacks or has reduced levels of CD7 and expresses a CD7 chimeric antigen receptor.

In some embodiments, the immune cell of the present invention can be co-administered with a cytokine. In some embodiments, the cytokine is IL-2, IFN-•, IFN-•, or a combination thereof. In some embodiments, the immune cell is co-administered with a chemotherapeutic agent. The chemotherapeutic can be cyclophosphamide, doxorubicin, vincristine, prednisone, or rituximab, or a combination thereof. Other chemotherapeutics include obinutuzumab, bendamustine, chlorambucil, cyclophosphamide, ibrutinib, methotrexate, cytarabine, dexamethasone, cisplatin, bortezomib, fludarabine, idelalisib, acalabrutinib, lenalidomide, venetoclax, cyclophosphamide, ifosfamide, etoposide, pentostatin, melphalan, carfilzomib, ixazomib, panobinostat, daratumumab, elotuzumab, thalidomide, lenalidomide, or pomalidomide, or a combination thereof. Such co-administration can be simultaneous administration or sequential administration. Sequential administration of a later-administered therapeutic agent or pharmaceutical composition can occur at any time during the course of treatment after administration of the first pharmaceutical composition or therapeutic agent.

In some embodiments of the present invention, an administered immune cell proliferates in vivo and can persist in the subject for an extended period of time. Immune cells of the present invention, in some embodiments can mature into memory immune cells and remain in circulation within the subject, thereby generating a population of cells able to actively respond to recurrence of a diseased or altered cell expressing the marker recognized by the chimeric antigen receptor.

Administration of the pharmaceutical compositions contemplated herein may be carried out using conventional techniques including, but not limited to, infusion, transfusion, or parenterally. In some embodiments, parenteral administration includes infusing or injecting intravascularly, intravenously, intramuscularly, intraarterially, intrathecally, intratumorally, intradermally, intraperitoneally, transtracheally, subcutaneously, subcuticularly, intraarticularly, subcapsularly, subarachnoidly and intrasternally.

Kits

The invention provides kits for the treatment of a neoplasia in a subject. In some embodiments, kit is for the treatment of a T- or NK-cell malignancy. In some embodiments, the T- or NK-cell malignancy is in precursor T- or NK-cells. In some embodiments, the T- or NK-cell malignancy is in mature T- or NK-cells. In some embodiments, the kit is for the treatment of a neoplasia selected from the group consisting of T-cell acute lymphoblastic leukaemia (T-ALL), mycosis fungoides (MF), Sezary syndrome (SS), Peripheral T/NK•cell lymphoma, Anaplastic large cell lymphoma ALK+, Primary cutaneous T•cell lymphoma, T· cell large granular lymphocytic leukemia, Angioimmunoblastic T/NK•cell lymphoma, Hepatosplenic T•cell lymphoma, Primary cutaneous CD30+lymphoproliferative disorders, Extranodal NK/T•cell lymphoma, Adult T•cell leukemia/lymphoma, T•cell prolymphocytic leukemia, Subcutaneous panniculitis•like T-cell lymphoma, Primary cutaneous gamma•delta T-cell lymphoma, Aggressive NK•cell leukemia, and Enteropathy•associated T•cell lymphoma. In some embodiments, the kit is for the treatment of a human subject.

In some embodiments, the kit comprises any of the chimeric antigen receptors as provided herein. In some embodiments, the kit comprises a nucleic acid encoding any of the chimeric antigen receptors as provided herein. In some embodiments, the kit comprises any of the modified immune cells as provided herein. In some embodiments, the kit includes a CD2 chimeric antigen receptor (CAR) engineered with a CD2 co-stimulatory domain. In some embodiments, the kit includes a modified immune cell having fratricide resistance, the immune cell comprising a mutation in a CD2 polypeptide and expressing a CD2 chimeric antigen receptor (CAR) engineered with a CD2 co-stimulatory domain. In some embodiments, the kit further includes a modified immune cell expressing a CD5 CAR and/or a modified immune cell expressing a CD7 CAR. In some embodiments, any of the immune cells further comprises a mutation in a CD3, TRAC, PD1, B2M, CIITA, TRBC1, TRBC2, and/or CD52 polypeptide, or a combination thereof. In some embodiments, the kit includes a population of any of the modified immune cells provided herein. In some embodiments, the kit comprises any of the pharmaceutical compositions as provided herein. In some embodiments, the kit includes a population of CD2 modified immune cells or a pharmaceutical composition comprising a CD2 modified immune cell or population of modified immune cells. In some embodiments, the kit includes a population of CD5 modified immune cells or a pharmaceutical composition comprising a CD5 modified immune cell or population of modified immune cells. In some embodiments, the kit includes a population of CD7 modified immune cells or a pharmaceutical composition comprising a CD7 modified immune cell or population of modified immune cells.

In some embodiments, the kit further includes a base editor polypeptide or a polynucleotide encoding a base editor polypeptide, wherein the base editor polypeptide comprises a nucleic acid programmable DNA binding protein (napDNAbp) and a deaminase. In some embodiments, the napDNAbp is Cas9 or Cas12. In some embodiments, the polynucleotide encoding the base editor is a mRNA sequence. In some embodiments, the deaminase is a cytidine deaminase or an adenosine deaminase.

The invention also provides kits comprising a nucleic acid construct comprising a nucleotide sequence encoding a nucleobase editor and a guide RNA. In some embodiments, the nucleic acid construct comprises a heterologous promoter that drives expression of the nucleobase editor. In some embodiments, this disclosure provides kits comprising a nucleic acid construct, comprising (a) a nucleotide sequence encoding (a) a Cas9 domain fused to a cytidine or adenosine deaminase as provided herein; and (b) a heterologous promoter that drives expression of the sequence of (a). In some embodiments, the Cas9 domain is fused to a cytidine deaminase. In some embodiments, the Cas9 domain is fused to an adenosine deaminase.

In some embodiments, the kit comprises a cytidine deaminase nucleobase editor and a guide RNA. In some embodiments, the kit comprises an adenosine deaminase nucleobase editor and a guide RNA. In some embodiments, the kit further one or more guide nucleic acid sequences. In some embodiments, the one of more guide nucleic acid sequences target CD2. In some embodiments, the one or more guide nucleic acid sequences target each one of CD2, CD52, TRAC, B2M, CIITA, TRBC1, TRBC2, and PDC1/PD-1. In some embodiments, the guide RNA has a nucleic acid sequence that is at least 85% complementary to a nucleic acid sequence of a gene encoding CD2. In some embodiments, the kit comprises a cytidine deaminase nucleobase editor and a CD2 guide RNA. In some embodiments, the guide RNA has a nucleic acid sequence that is at least 85% complementary to a nucleic acid sequence of a gene encoding CD5. In some embodiments, the guide RNA has a nucleic acid sequence that is at least 85% complementary to a nucleic acid sequence of a gene encoding CD7. In some embodiments, the kit may further include one or more additional guide RNAs, each guide RNA having a nucleic acid sequence at least 85% complementary to a nucleic acid sequence of gene encoding TRAC, PD1, B2M, CIITA, TRBC1, TRBC2, and/or CD52.

The neoplasia treatment kits may further comprise written instructions for using the modified immune cells in the treatment of the neoplasia. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR. The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Treatment of T-ALL with Fratricide Resistant CAR-T Cells

T-cell acute lymphoblastic leukaemia (T-ALL) is an aggressive malignant neoplasm of the bone marrow. About 12-15% of T-ALL cases are diagnosed in children. Post-relapse 5 year survival is less than 25%. The standard of care is to use chemotherapy to induce a second remission followed by allogeneic hematopoietic stem cell transplantation (alloHSCT). However, many patients are refractory to chemotherapy or have high tumor burden and are not able to induce deep remission as a bridge for alloHSCT. Moreover, heavily pretreated patients are often not candidates for autologous CAR-T treatment. Accordingly, alternative treatment options are needed for the treatment of T-ALL.

Figure 2:
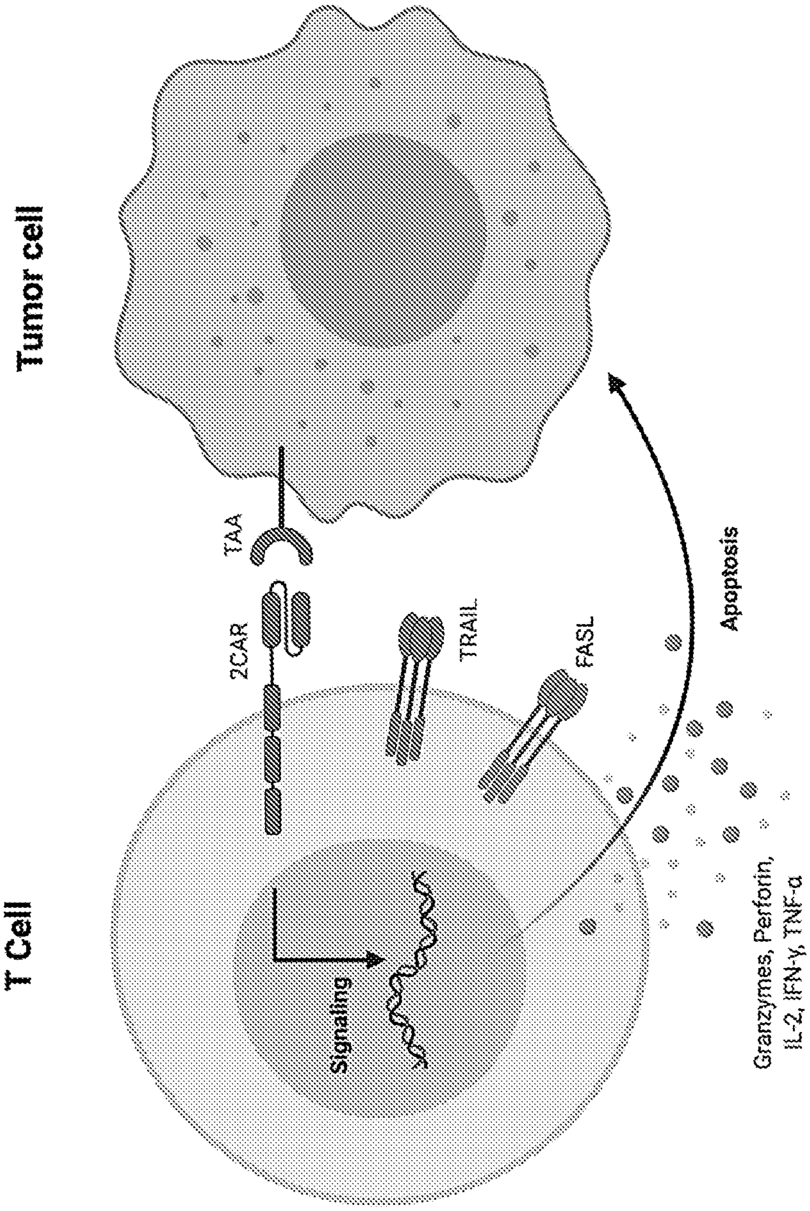
FIG. 2 is a schematic drawing depicting a T cell expressing an anti-CD2 chimeric antigen receptor (CAR) (alternatively, CD2 CAR) containing a CD2 co-stimulatory domain and a tumor cell.
Figure 3:
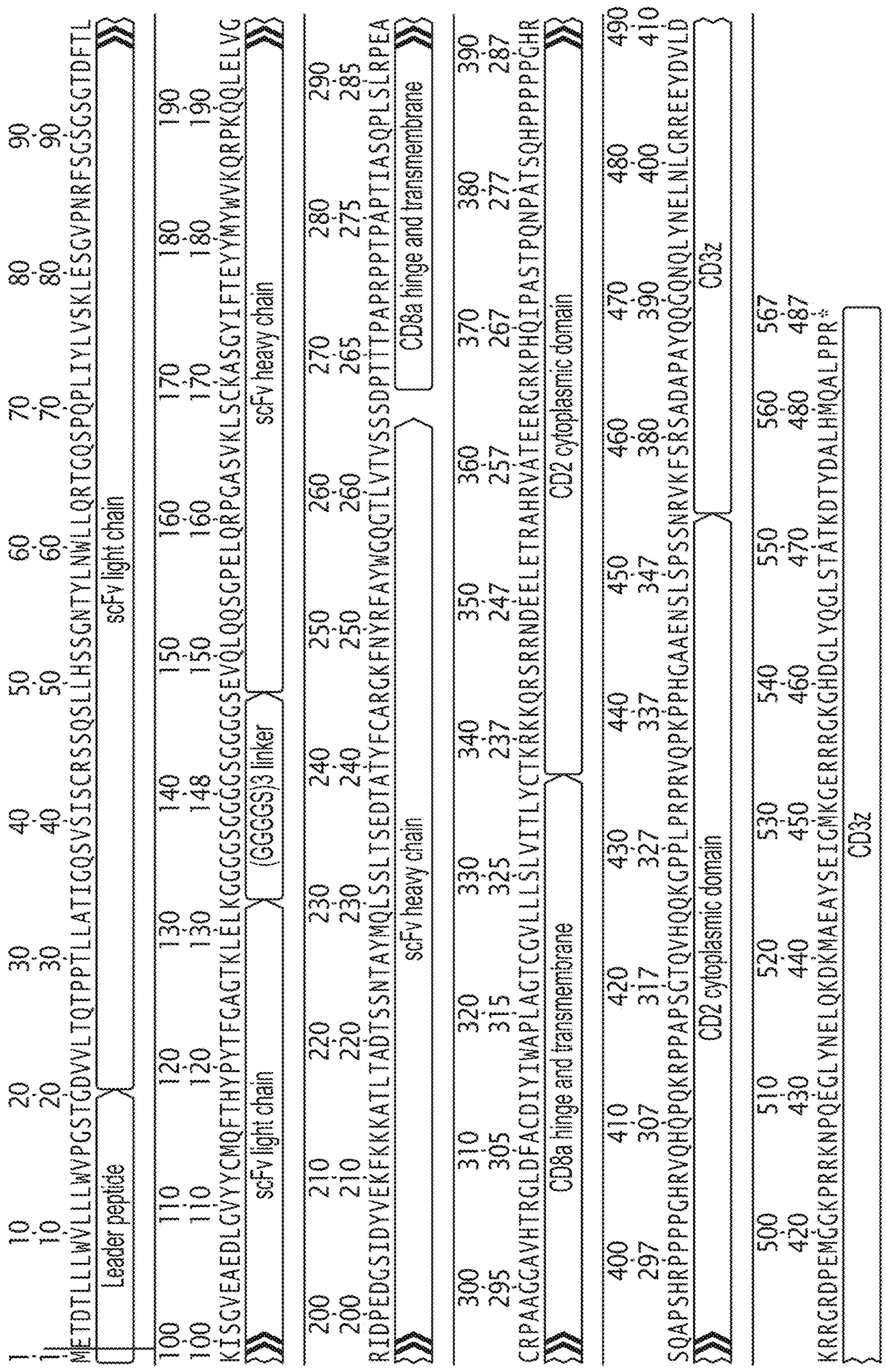
FIG. 3 depicts the architecture and amino acid sequence of an exemplary anti-CD2 chimeric antigen receptor (CAR). The anti-CD2 CAR architecture includes a leader peptide sequence, scFv light chain sequence, a $(GGGGS)_3$ (SEQ ID NO: 381) linker sequence, a scFv heavy chain sequence, a CD8• hinge and transmembrane domain sequence, a CD2 cytoplasmic domain sequence, and a CD3• domain sequence. The sequences shown in FIG. 3 correspond to SEQ ID NOs: 754 and 381.
Figure 4:
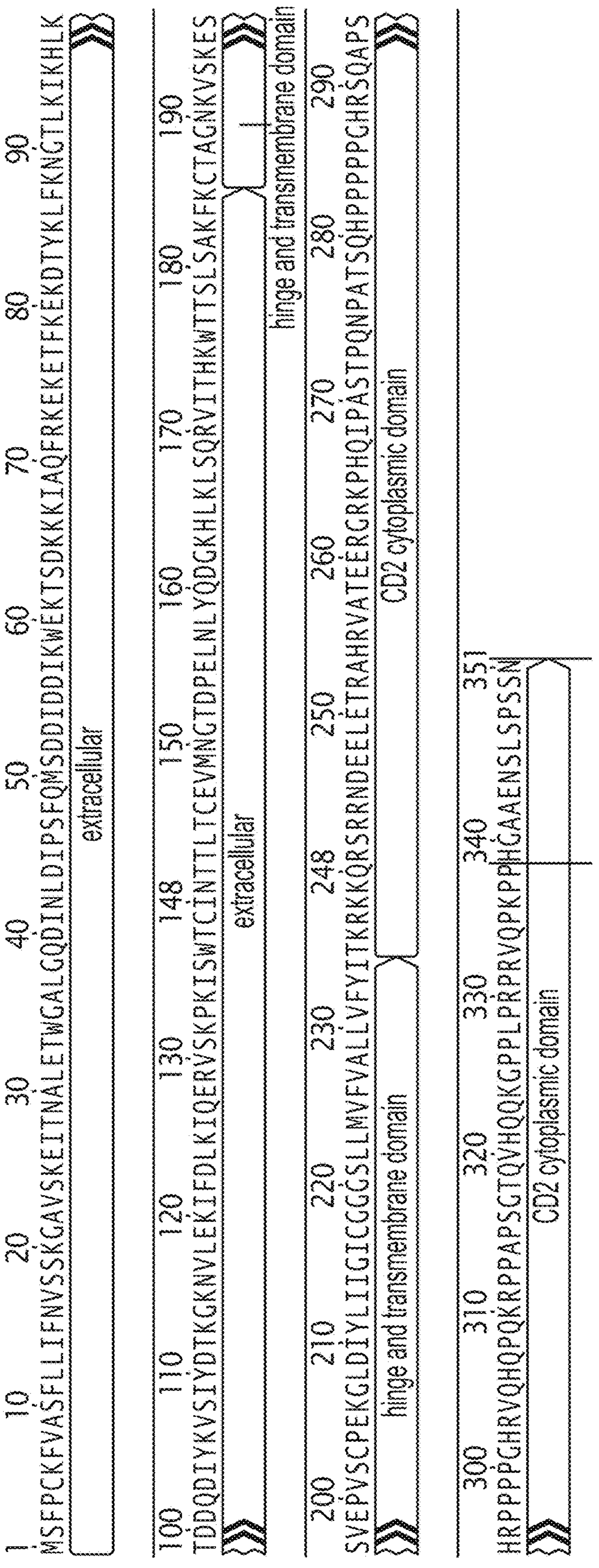
FIG. 4 depicts the architecture and amino acid sequence of a human CD2 protein. The human CD2 protein architecture includes an extracellular domain, a hinge and transmembrane domain, and a CD2 cytoplasmic domain. The sequence shown in FIG. 4 corresponds to SEQ ID NO: 734.

To examine whether edited CAR-T cells can induce remission in patients in order to bridge treatment with alloHSCT, multiplex editing is used to create a fratricide resistant CAR-T cell. As shown in FIG. 1, a T-cell expressing a CD2 chimeric antigen receptor is edited to reduce or eliminate expression of CD2, TRAC, CD52, and PD-1 for targeting $CD3^-$ $CD2^+$ or $CD3^+$ $CD2^+$ T-ALL tumor cells. An anti-CD2 chimeric antigen receptor (CAR) is engineered with a CD2 co-stimulatory domain, which corresponds to residues 235-351 of the human CD2 cytoplasmic domain (FIGS. 3, 4). The architecture and amino acid sequence of the anti-CD2 CAR is shown in FIG. 3 and contains a leader peptide sequence, scFv light chain, $(GGGGS)_3$ (SEQ ID NO: 381) linker, scFv heavy chain, CD8• hinge and transmembrane domain, human CD2 cytoplasmic domain, and a CD3• domain. The anti-CD2 CAR is then transfected into the edited T-Cell to generate a CD2 CAR-T cell that targets malignant T-cells that express CD2 (FIG. 2).

Figure 6:
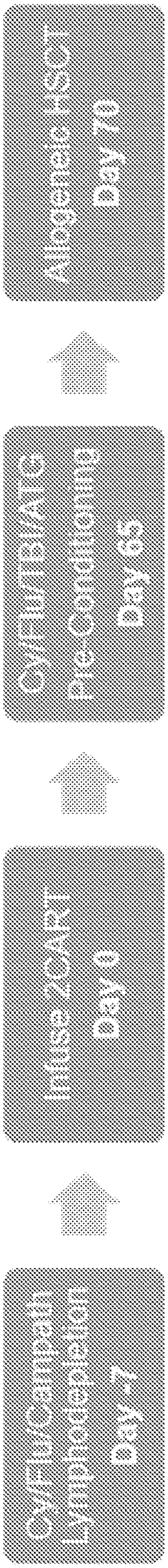
FIG. 6 is a flow chart depicting a clinical protocol for treating patients with CD2 CAR-T cells.
Figure 7A:
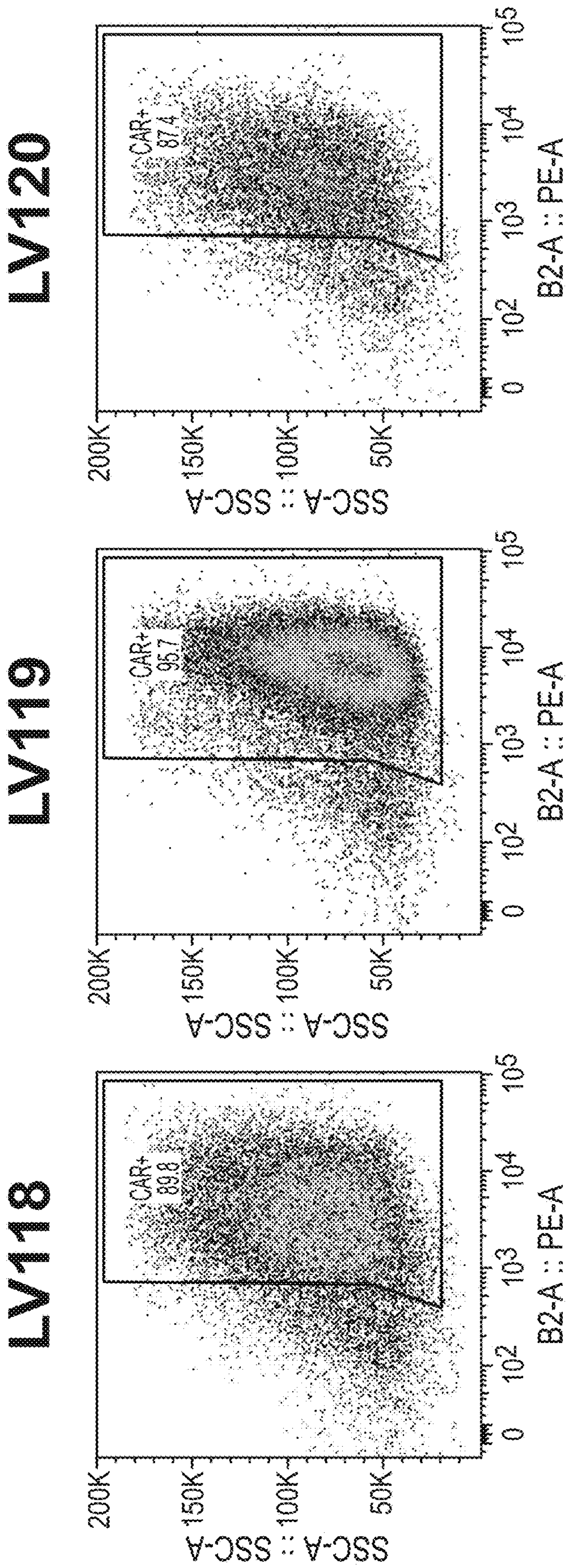
FIGS. 7A-7E provide flow cytometry plots demonstrating the expression of the indicated anti-CD2 chimeric antigen receptors (CARs) on the surface of T cells. The same cell populations sampled for preparation of FIGS. 7A-7E were sampled for preparation of FIGS. 8A-8F.
Figure 7B:
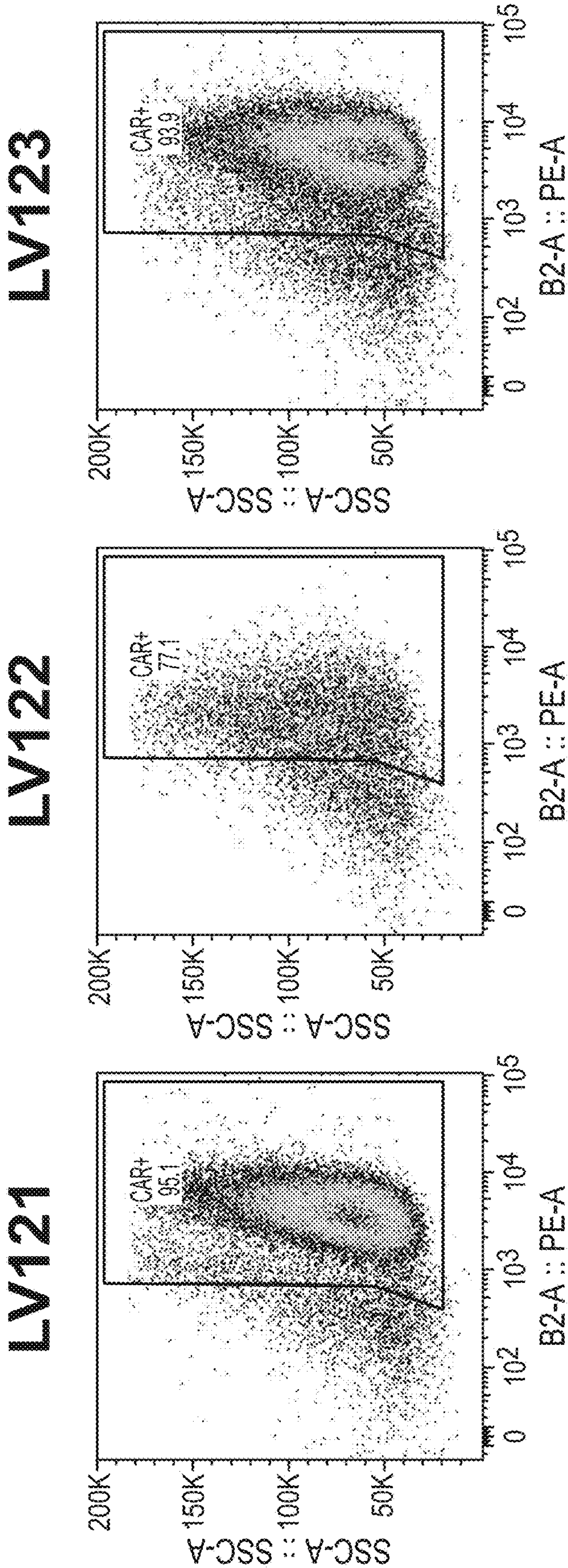
Figure 7C:
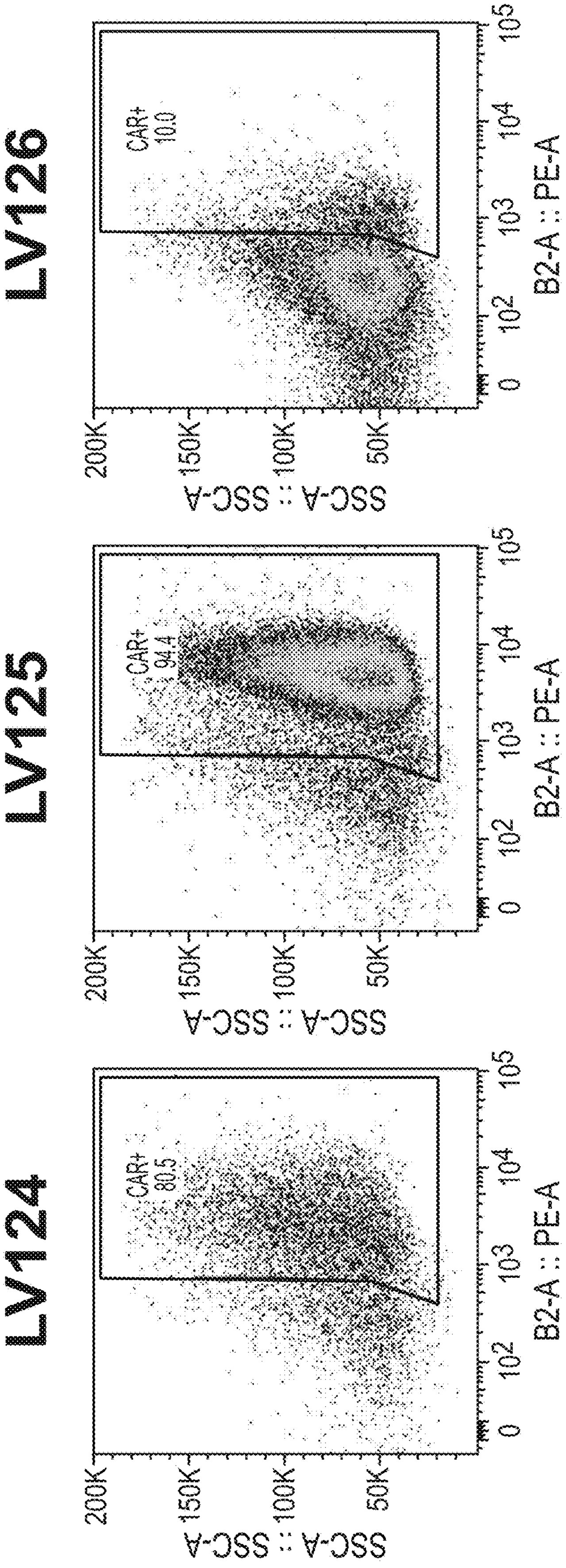
Figure 7D:
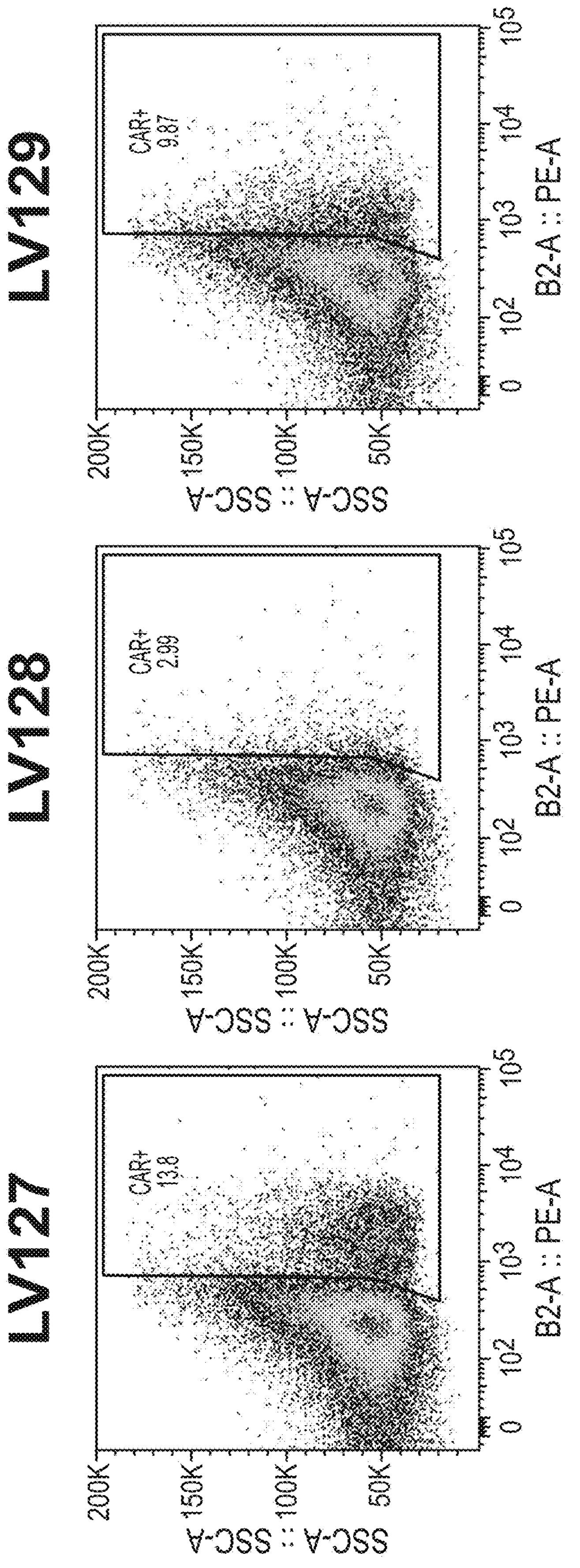
Figure 7E:
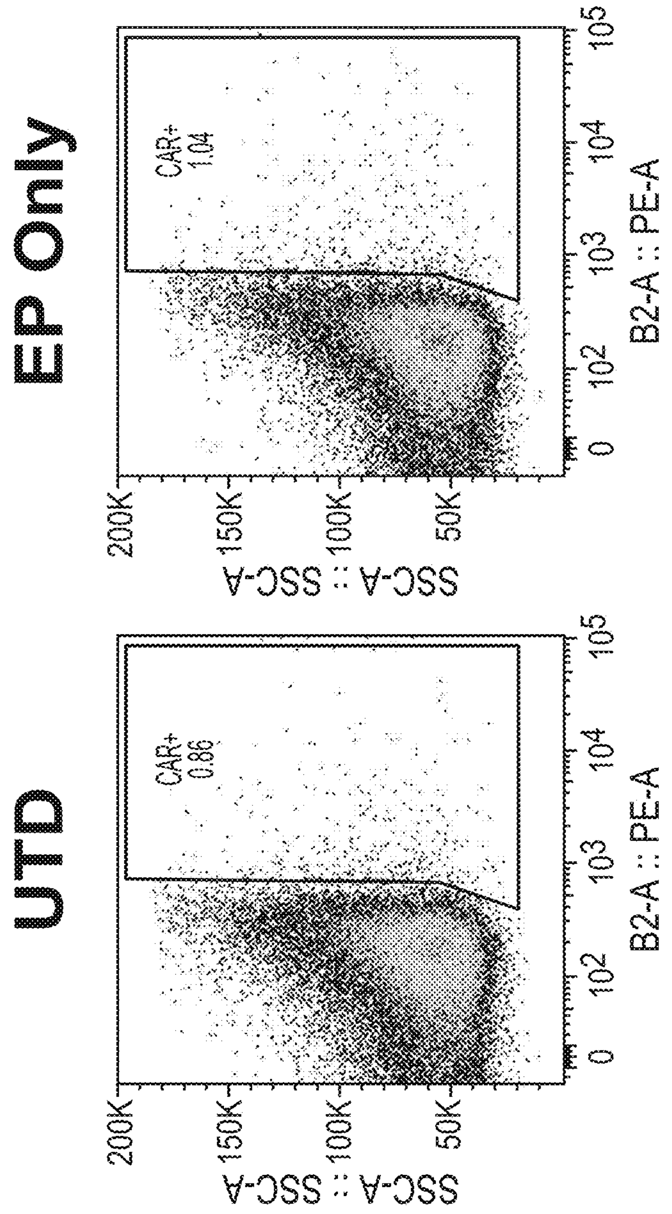
Figure 8A:
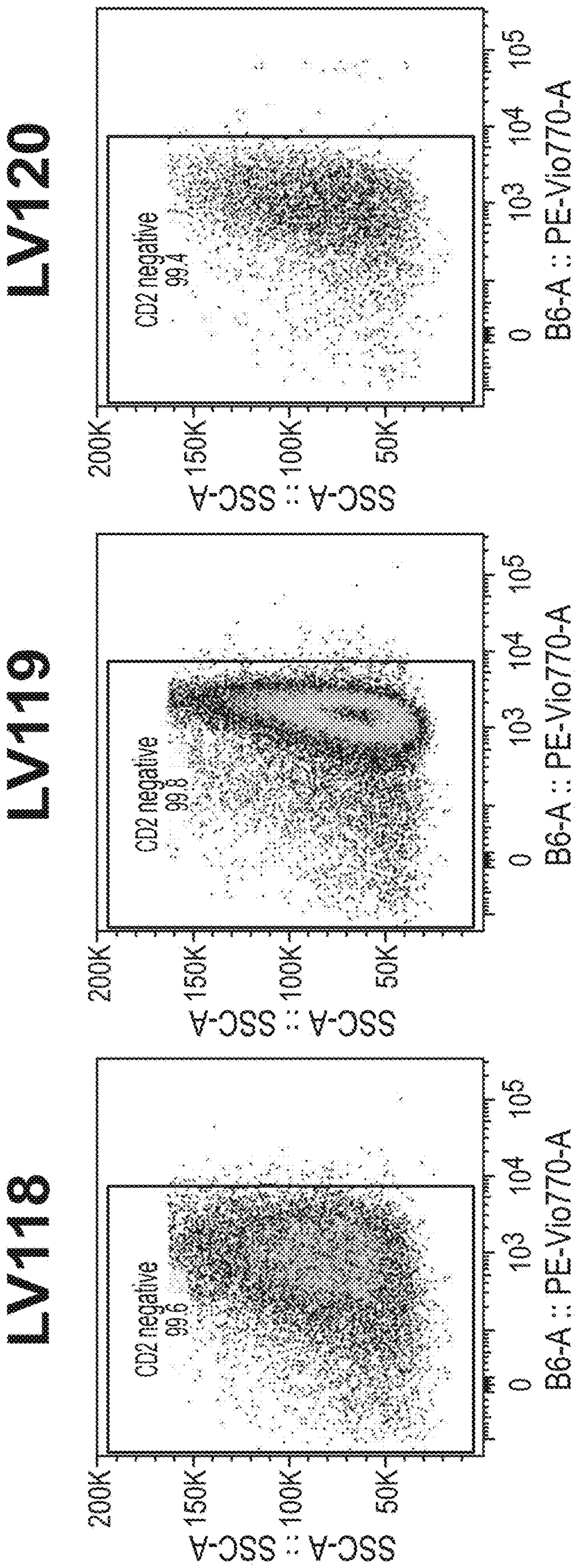
FIGS. 8A-8F provide flow cytometry plots, a set of histograms demonstrating that populations of cells transduced with indicated anti-CD2 CAR constructs self-purified for cells with CD2 gene expression knocked out using base editing according to the methods provided herein, and a Table providing the sample name, subset name, and lentivirus vectors used in FIGS. 8A-8F. The same cell populations sampled for preparation of FIGS. 7A-7E were sampled for preparation of FIGS. 8A-8F.
Figure 8B:
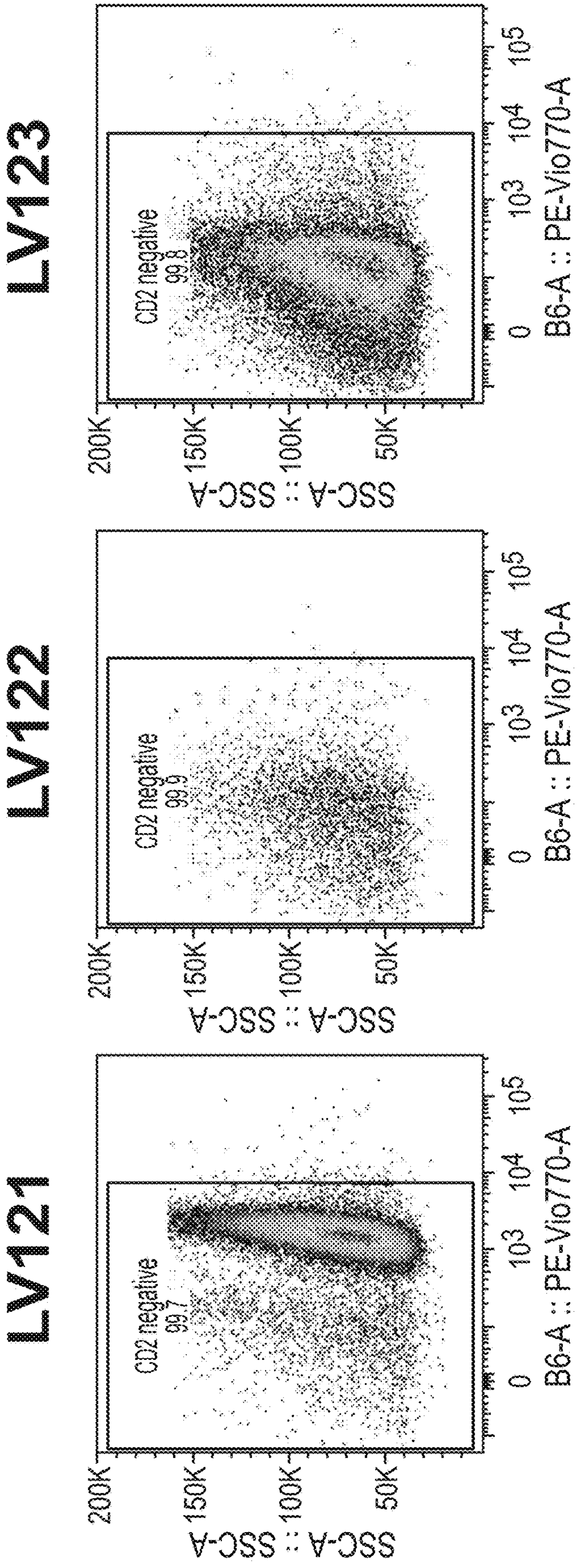
Figure 8C:
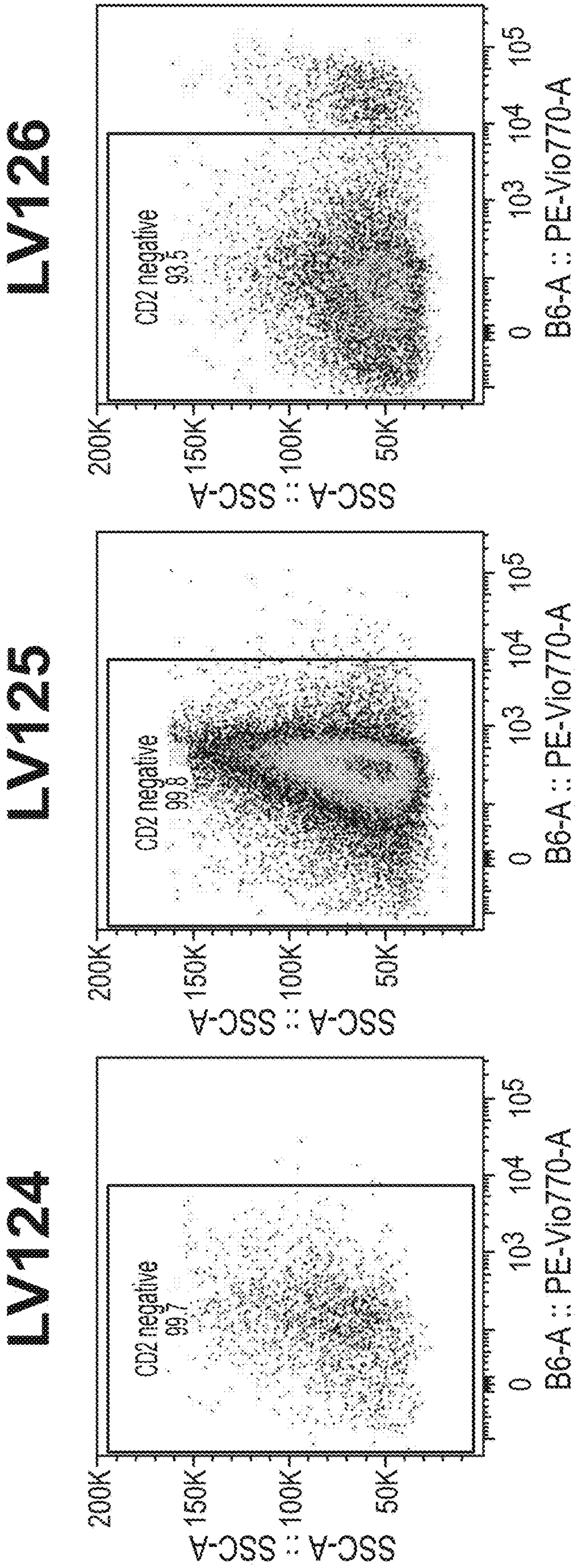
Figure 8D:
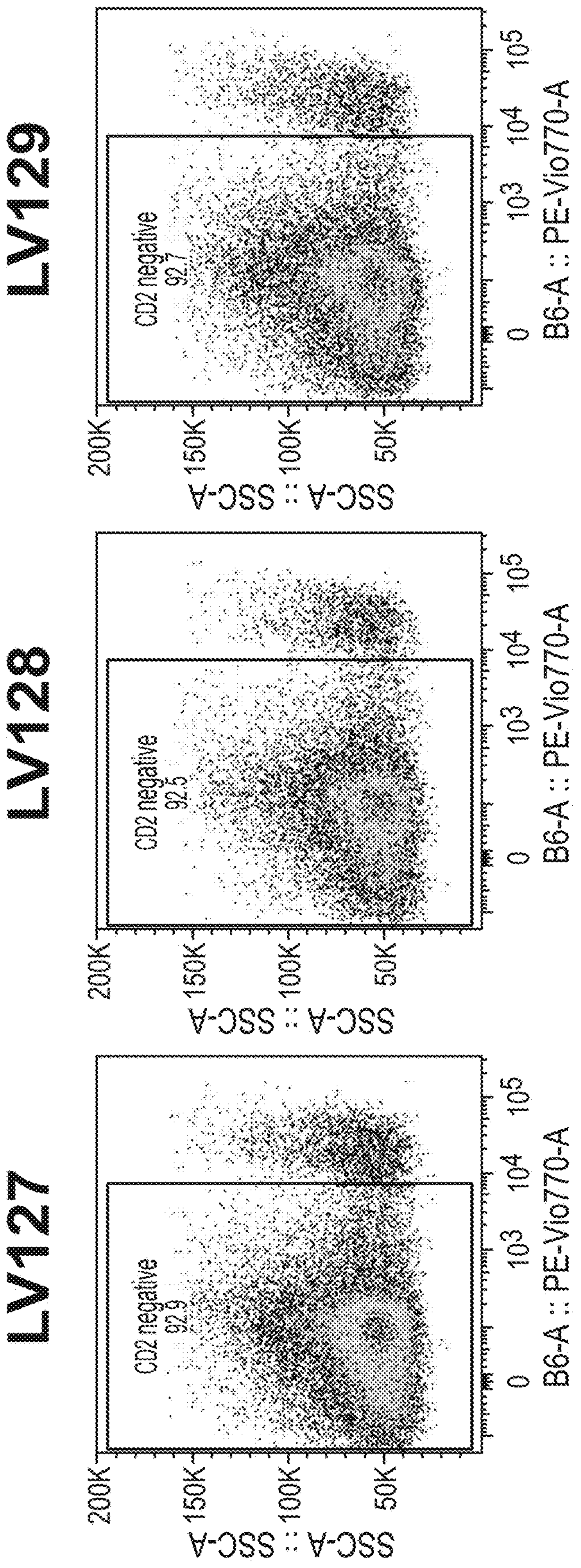
Figure 8E:
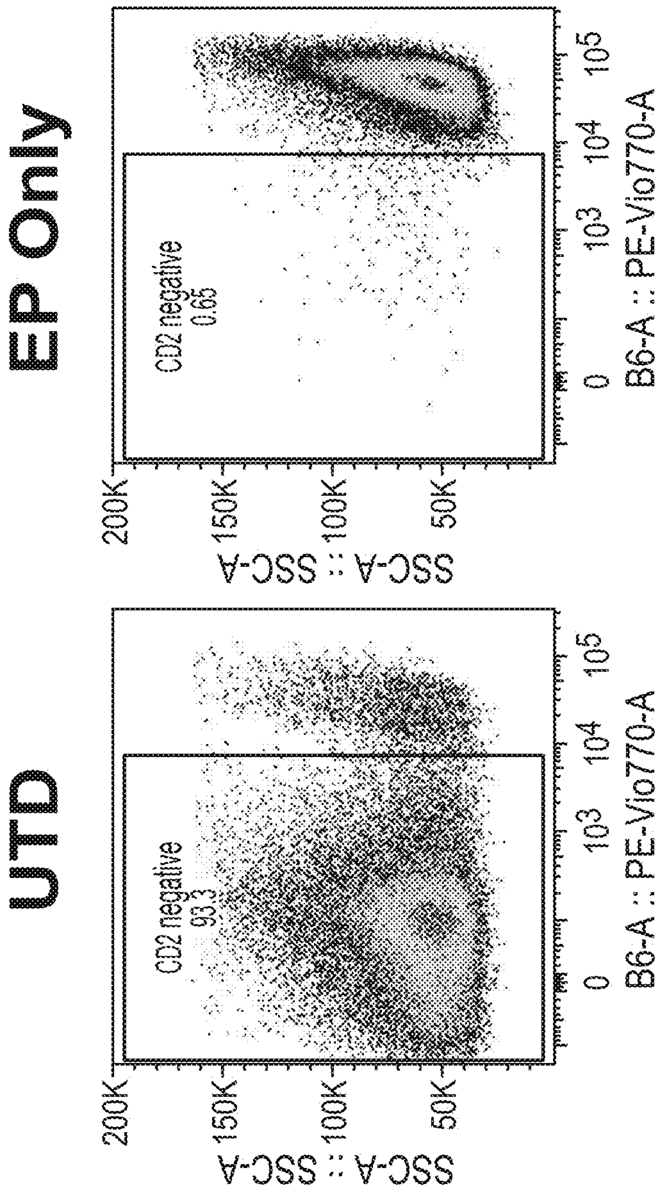
Figure 8F:
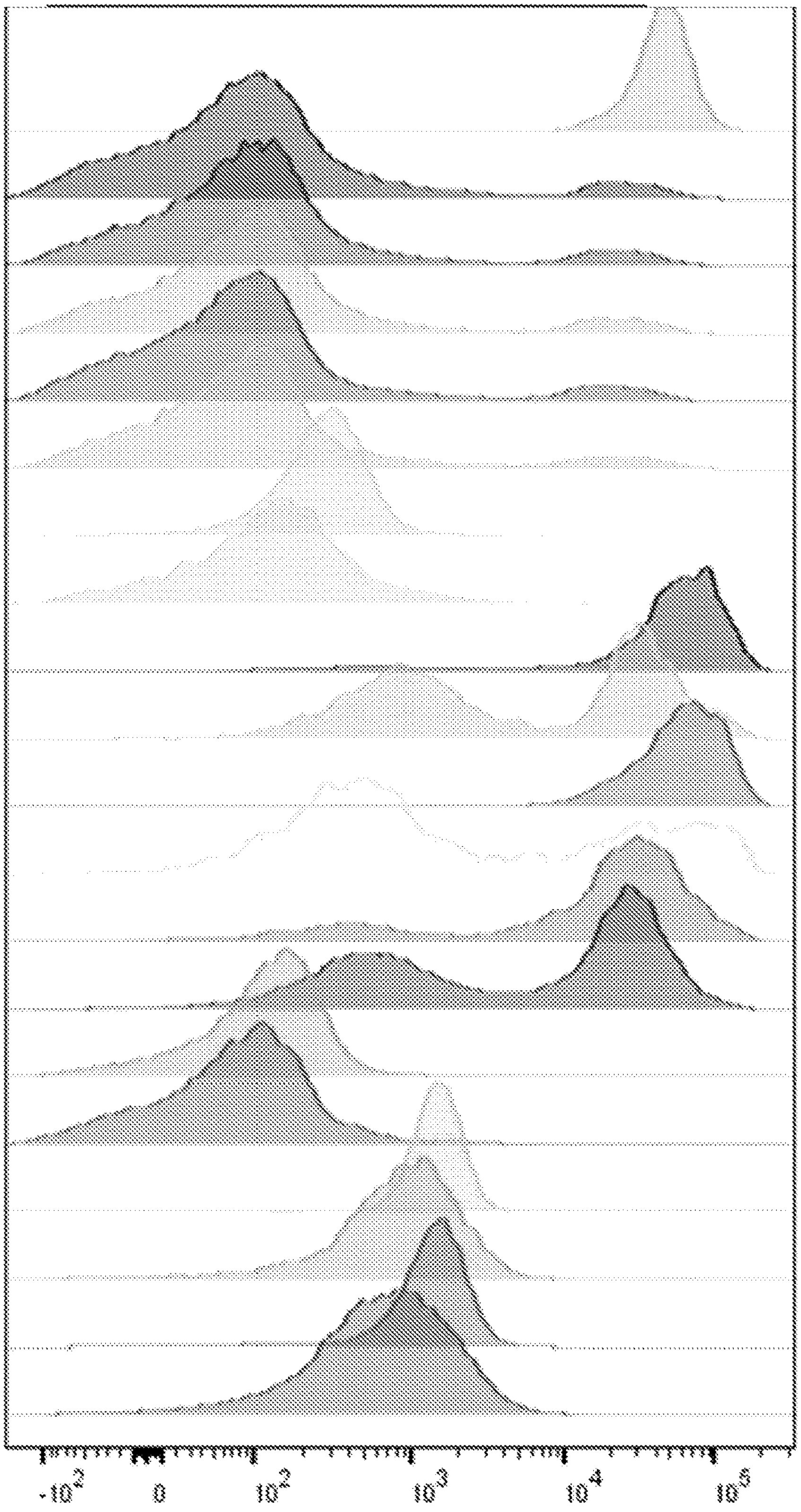

As shown in FIG. 6, lymphodepletion is conducted in about 30-40 T-ALL patients with Cy/Flu/Campath at day −7. At day 0, patients are infused with CD2 CAR-T cells. The patients are then pre-conditioned with Cy/Flu/TBI/ATG at day 65. On day 70, patients receive treatment with alloHSCT. Treatment with CD2 CAR-T cells is expected to induce T cell aplasia and allow T-ALL patients to be treated with alloHSCT.

Example 2: Manufacture of Fratricide Resistant CAR-T Cells

To manufacture CD2 CAR-T cells, frozen apheresis was received from healthy donors. The apheresis was then thawed with Plasmatherm (Barkey GmbH & Co. KG). CD4 and CD8 T-cells were isolated from the thawed apheresis using CliniMACS Prodigy (Miltenyi Biotec). The T-cells were then activated using TransAct (a ready-to-use reagent available from Miltenyi Biotec for expansion and activation of human T cells via CD3 and CD28). mRNA-encoding base editors and guide RNAs were delivered into the T-cells by electroporation using Lonza SD Nucleofector (an electroporation device). Following base editing, a CD2 chimeric antigen receptor (CAR) (see e.g., FIG. 3) was delivered into the T-cells via lentiviral transduction. The T-cells were then expanded in culture. CD2 CAR expression was verified using flow cytometry. The harvested CAR-T cells were then cryopreserved with a controlled rate freezer (CRF).

CD2 CAR-T cells were verified for tonic and antigen-inducible signaling using cytokine ELISA after co-culture of CD2 CAR-T cells with $CD2^-$ or $CD2^+$ target cell lines. In vitro cytotoxicity was also measured against a CD2+ tumor cell line.

Example 3: Use of Cytosine Base Editing to Eliminate CD2 Expression in T-Cells

To reduce or eliminate expression of CD2 in T cells, cytidine base editor, BE4, single guide RNAs (sgRNAs) were generated (Agilent) comprising the spacer sequences as provided in Table 1 above. The scaffold sequence used for the sgRNAs was the spCas9 scaffold.

Figure 5:
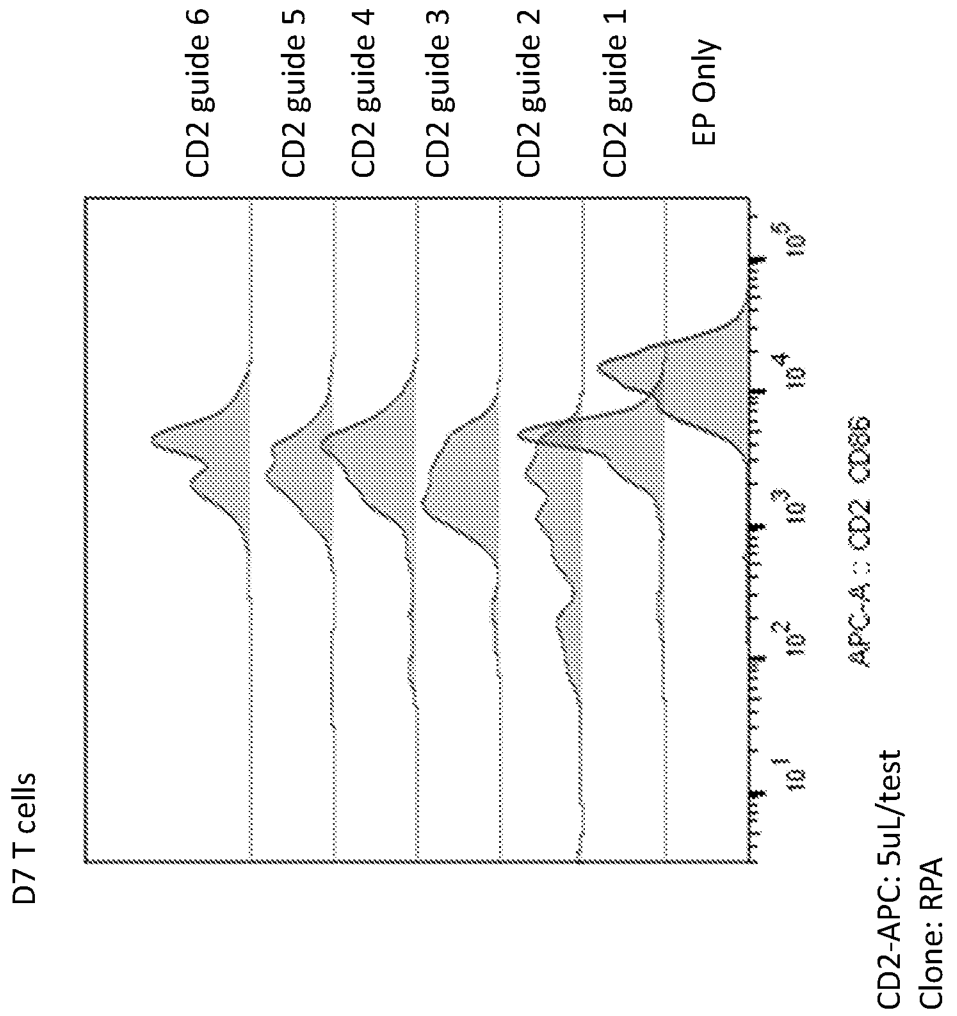
FIG. 5 provides histograms corresponding to flow cytometry plots depicting the use of six different sgRNAs to inactivate CD2 expression in D7 T cells. The monoclonal antibody clone RPA2.0 was used to detect CD2. 5 μL of CD2-APC was used per test. Electroporation only (EP) was used as a negative control.

CD2 editing was verified by screening the guides against a minimum of n=3 donors and a minimum of n=5 antibody clones using flow cytometry, next generation sequencing, and Western blot analysis (FIG. 5). The monoclonal antibody clone RPA2.10 (BioLegend®, Cat #300202) was used to detect CD2. 5 μL of CD2-APC was used per test. Electroporation only (EP) was used as a negative control. Use of cytidine base editors with the CD2 guide RNAs efficiently reduced or eliminated CD2 expression in T cells.

Example 4: Combination Therapy of T- or NK-Cell Malignancies Using Multiple Modified Immune Effector Cells To examine whether the use of multiple genetically modified CAR-T cells can enhance the treatment of patients with T- or NK-Cell malignancies, patients are administered one or more modified CAR-T cells based on their immunophenotype. Immune cells from patient samples were immunophenotyped for the presence or absence of CD2, CD5, and CD7 using flow cytometry and/or sequence analysis. mRNAs encoding base editors and guide RNA were delivered into the immune cells by electroporation to edit either CD2, CD5 or CD7 in combination with TRAC, CD52, B2M, CIITA, TRBC1, TRBC2, and PD-1 to reduce and or eliminate expression of these genes in the immune cells. Following base editing, a CD2 chimeric antigen receptor (CAR) engineered with a CD2 co-stimulatory domain (see e.g., FIG. 3), a CD5 CAR, or a CD7 CAR was delivered into the modified immune cells via lentiviral transduction to create CD2, CD5, and CD7 CAR-T cells, respectively.

Patients having cancers that were immunophenotyped as $CD2^+$ $CD5^+$ $CD7^-$ were treated with both a CD2 CAR-T cell and a CD5 CAR-T cell. Patients having cancers that were immunophenotyped as $CD2^+$ $CD5^+$ $CD7^+$ were treated with both a CD2 CAR-T cell and a CD7 CAR-T cell. Patients having cancers that were immunophenotyped as $CD2^+$ $CD5^+$ $CD7^+$ were treated with a CD2 CAR-T cell, a CD5 CAR-T cell, and a CD7 CAR-T cell.

Example 4: Knockout of CD2 Expression in CD2 Chimeric Antigen Receptor (CAR)-T Cells is Beneficial Experiments were undertaken to evaluate the effect on fratricide in CD2 CAR-T cells of knocking out the CD2 gene in the cells using base editing. The methods described in Examples 1-4 were used to prepare T cell populations (e.g., untransduced cells ("UTD") or "CD2 Edit" cells) base-edited to knock out expression of the CD2 gene, and T cell populations transduced with the anti-CD2 chimeric antigen receptor (CAR) constructs listed in Table 20 below. The lentiviral vectors used in the experiment were commercially available $3^{rd}$ generation, pseudotyped lentivirus vectors.

TABLE 20 anti-CD2 CAR Constructs (in the constructs, the following is a general description of the domain architecture from the N-terminus to the C-terminus: scFv domain, costimulatory domain, CD3z signaling domain)

| Construct | Sequence |
|---|---|
| CAR BTx118 | Rat LO-CD2a VL-VH-CD2-3z |
| CAR BTx119 | Rat LO-CD2a VL-VH-CD28-3z |
| CAR BTx120 | Rat LO-CD2a VH-VL-CD2-3z |
| CAR BTx121 | Rat LO-CD2a VH-VL-CD28-3z |
| CAR BTx122 | HuLO CD2a VL-HuLO-CD2a VH-CD2-3z |
| CAR BTx123 | HuLO CD2a VL-HuLO-CD2a VH-CD28-3z |
| CAR BTx124 | HuLO-CD2a VH-HULO CD2a VL-CD2-3z |
| CAR BTx125 | HuLO-CD2a VH-HuLO CD2a VL-CD28-3z |
| CAR BTx126 | HuLO-CD2a VL-MEDI-507 VH-CD2-3z |
| CAR BTx127 | HuLO-CD2a VL-MEDI-507 VH-CD28-3z |
| CAR BTx128 | MEDI-507 VH-HuLO-CD2a-CD2-3Z |
| CAR BTx129 | MEDI-507 VH-HuLO-CD2a-CD28-3Z |

Figure 9:
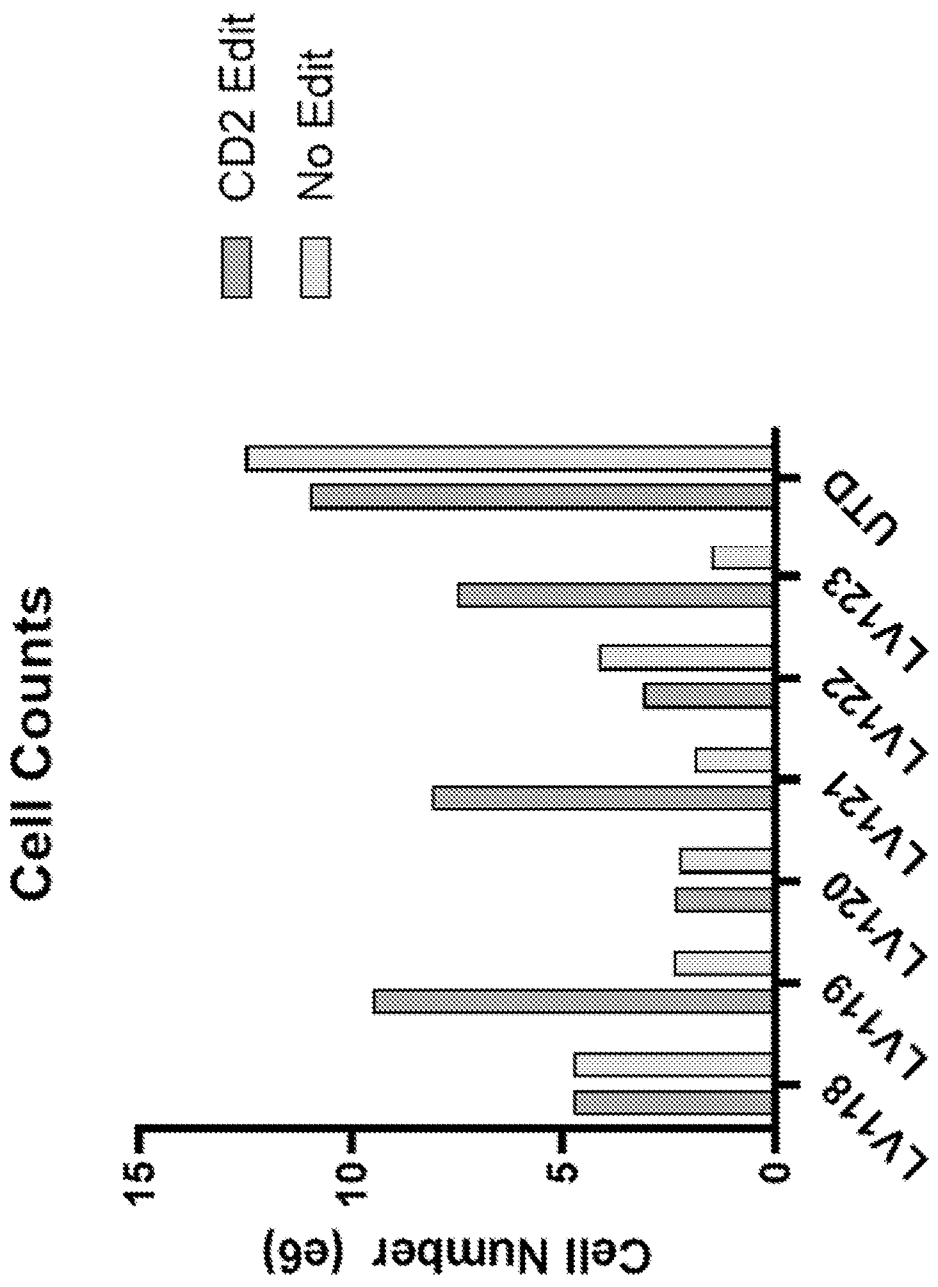
FIG. 9 provides a bar graph showing total cell counts taken at day 10 post-transduction with the indicated lentivirus vectors.
Figure 10A:
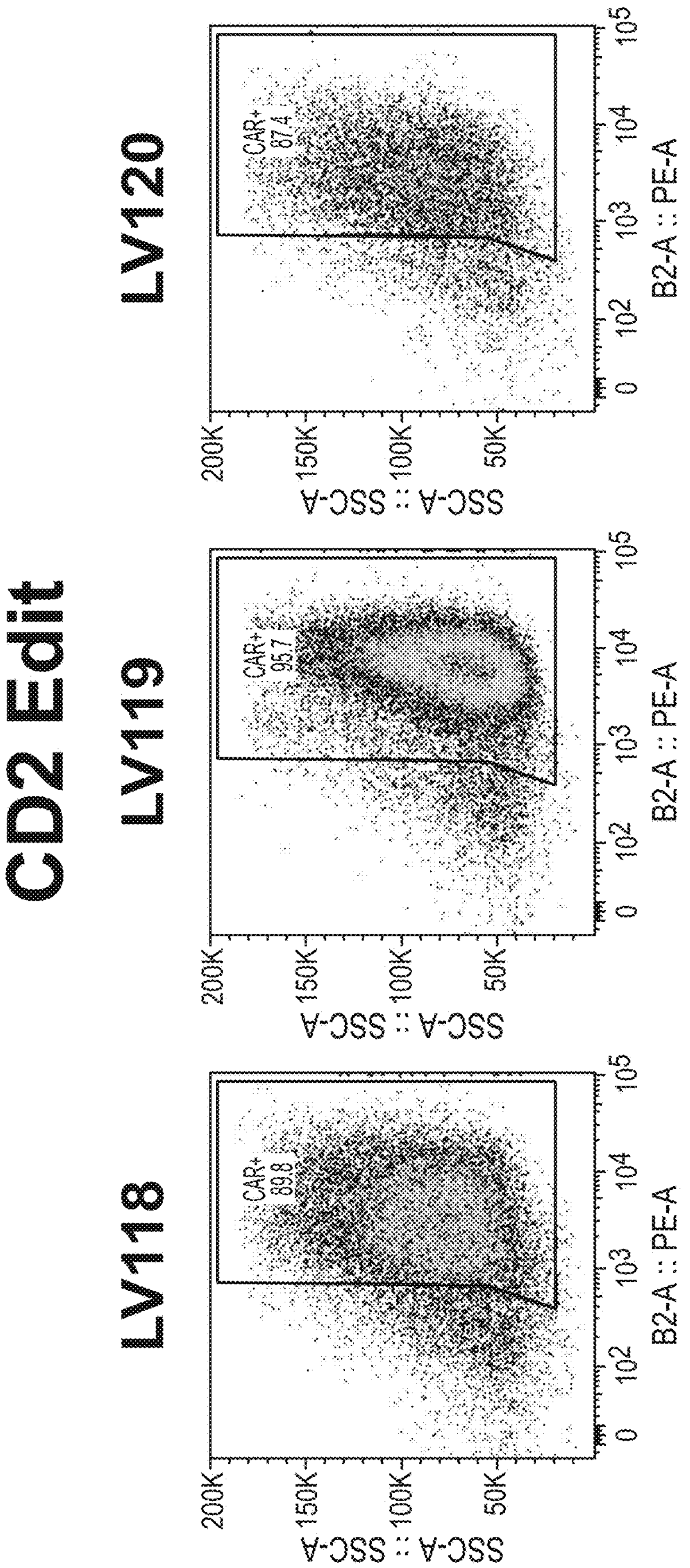
FIGS. 10A-10D provide flow cytometry plots demonstrating that it was necessary to knock out expression of the CD2 gene in cell populations expression the anti-CD2 chimeric antigen receptors (CARs) to prevent fratricide.
Figure 10B:
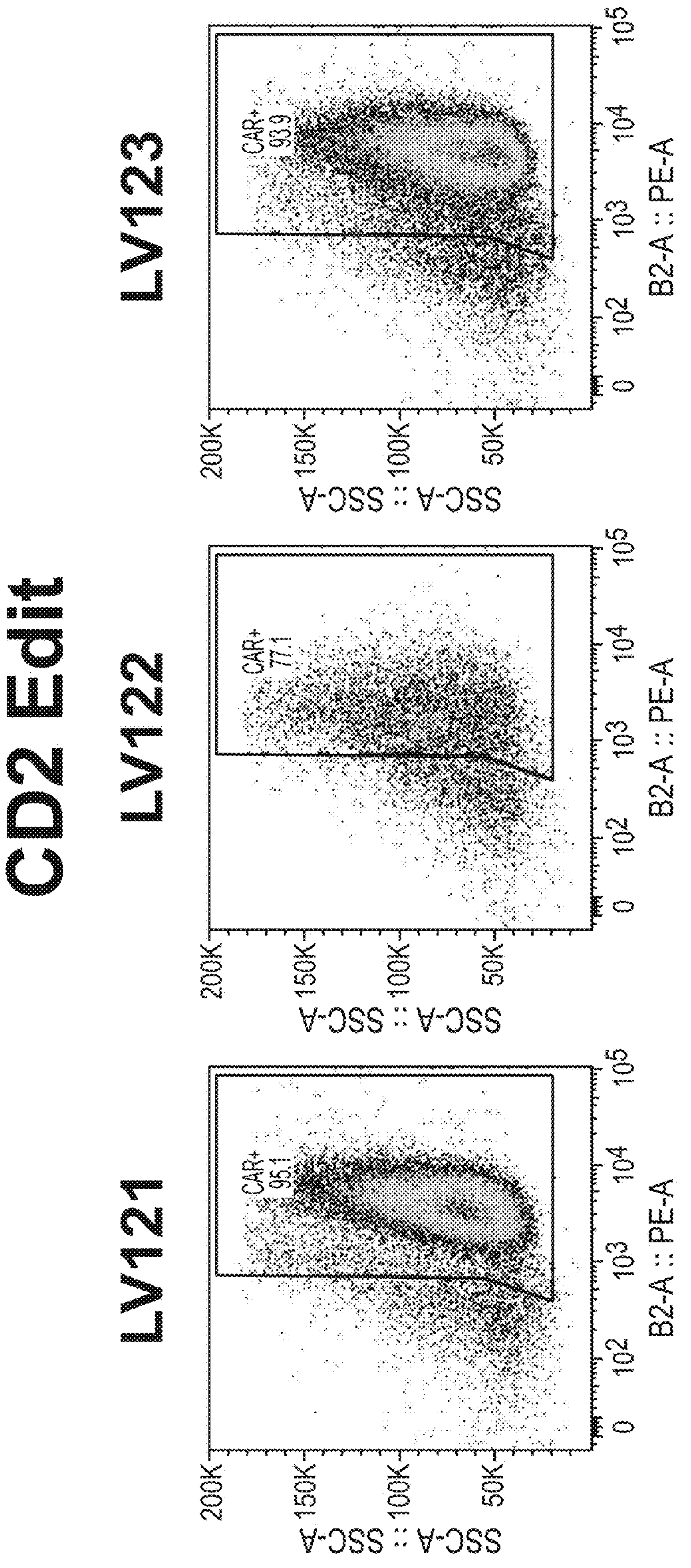
Figure 10C:
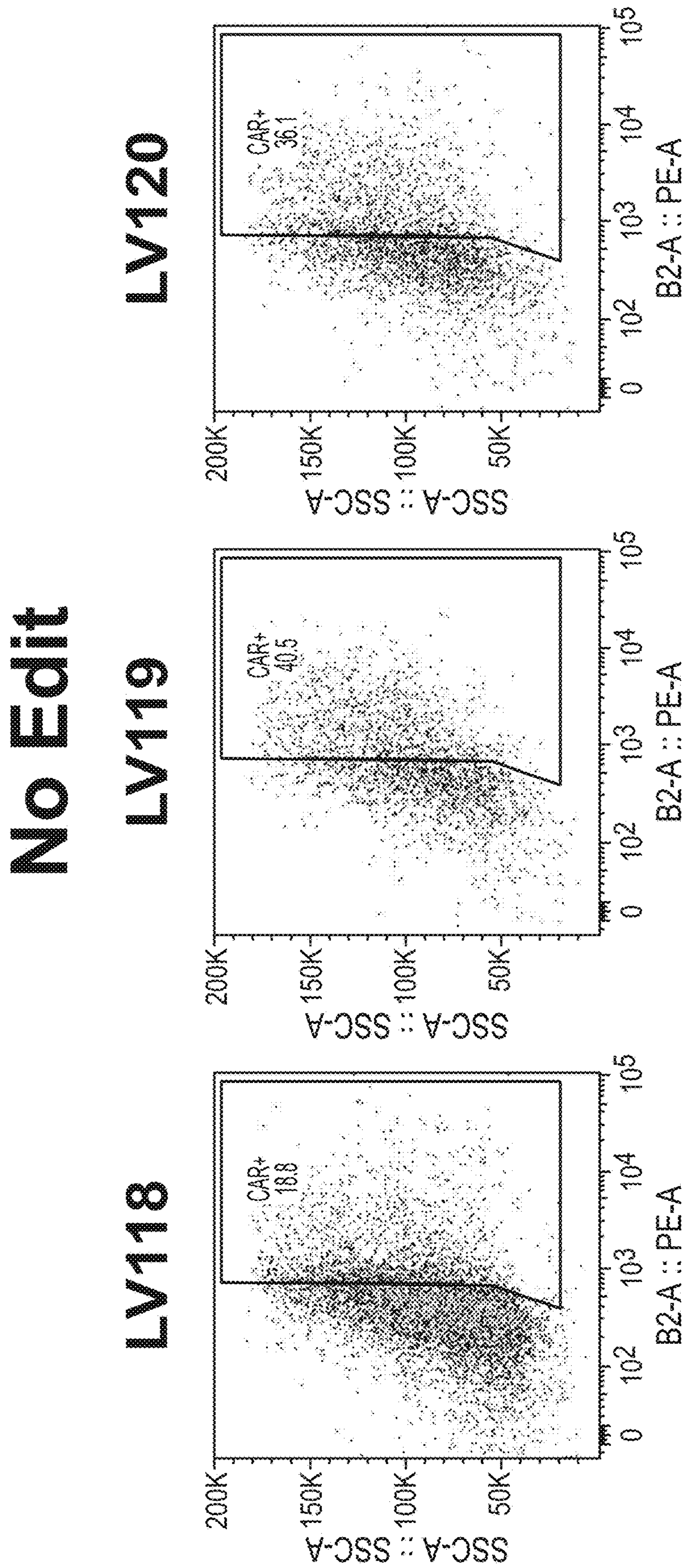
Figure 10D:
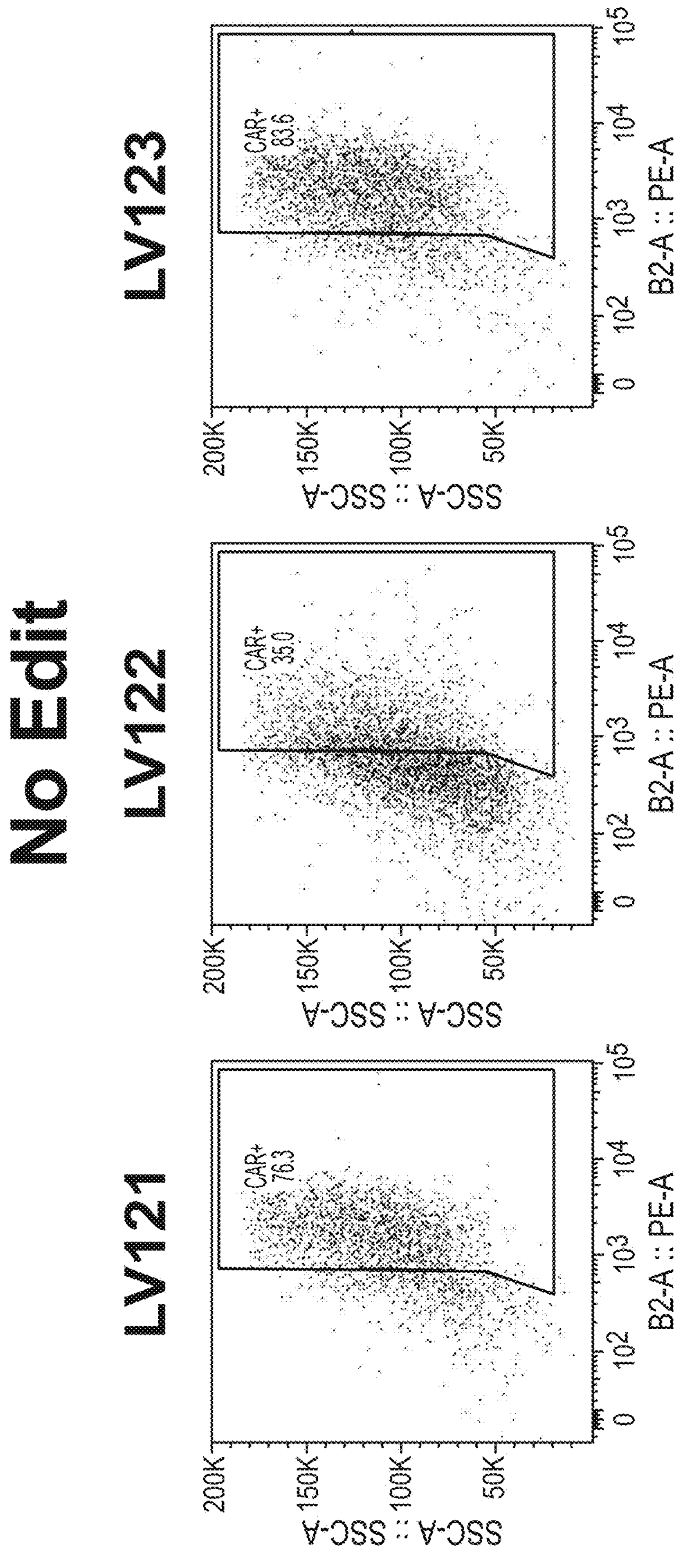
Figure 11A:
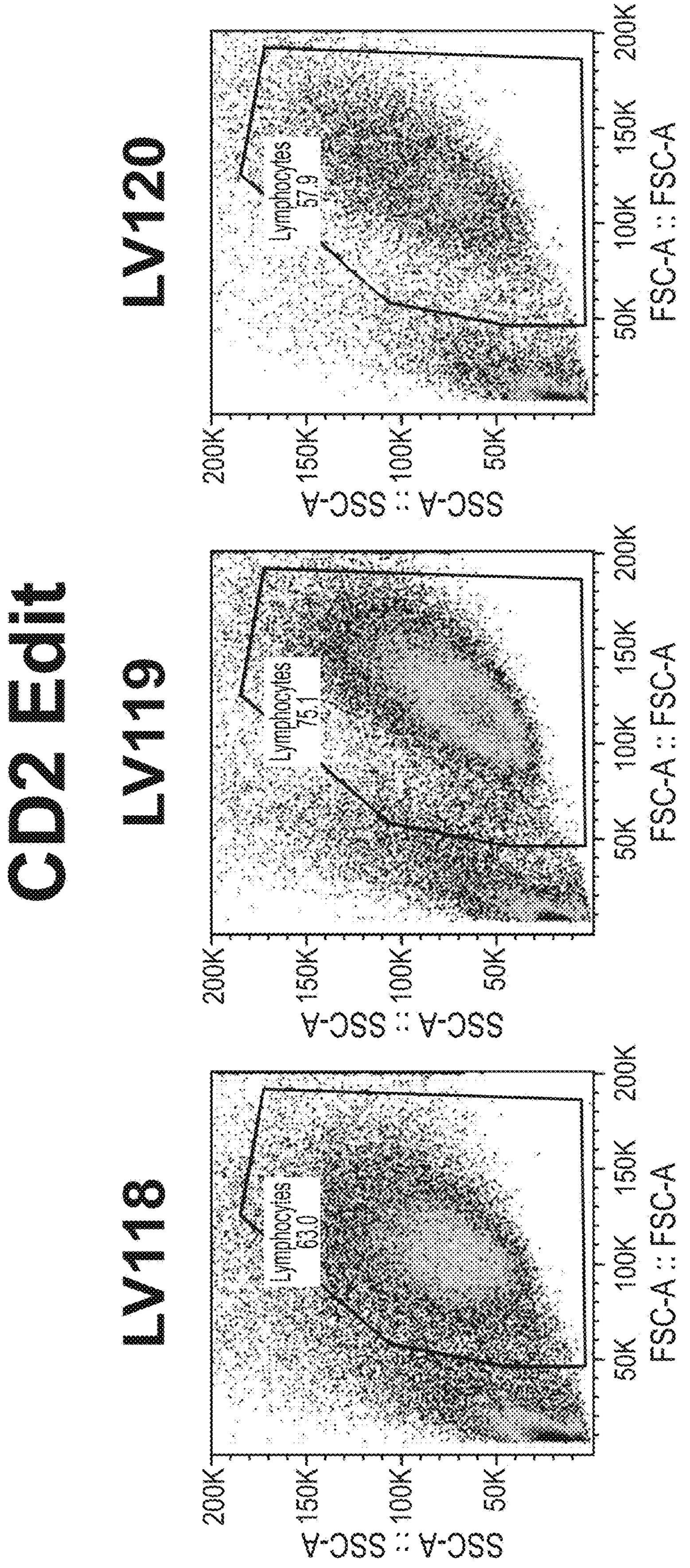
FIGS. 11A-11D provide flow cytometry plots demonstrating that it was necessary to knock out expression of the CD2 gene in cell populations expressing the anti-CD2 chimeric antigen receptors (CARs) to prevent fratricide.
Figure 11B:
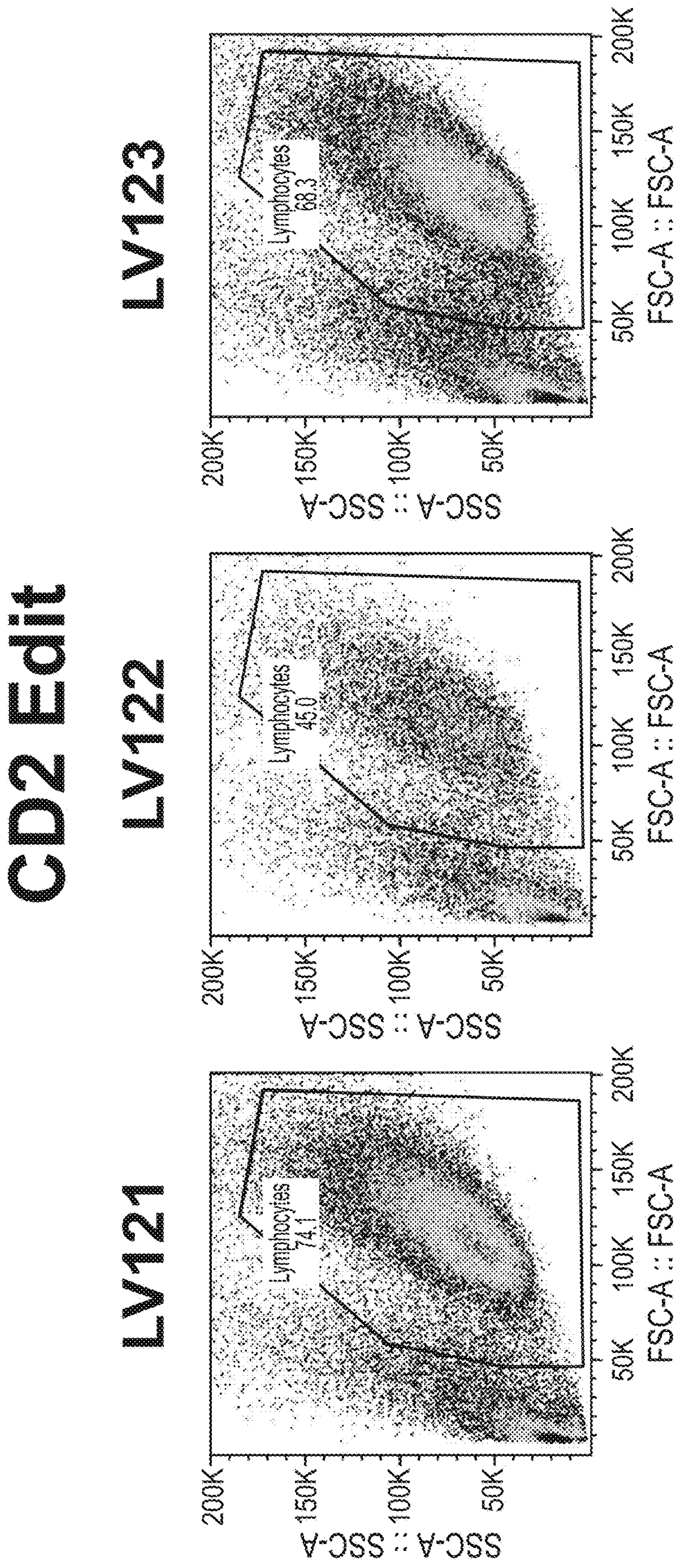
Figure 11C:
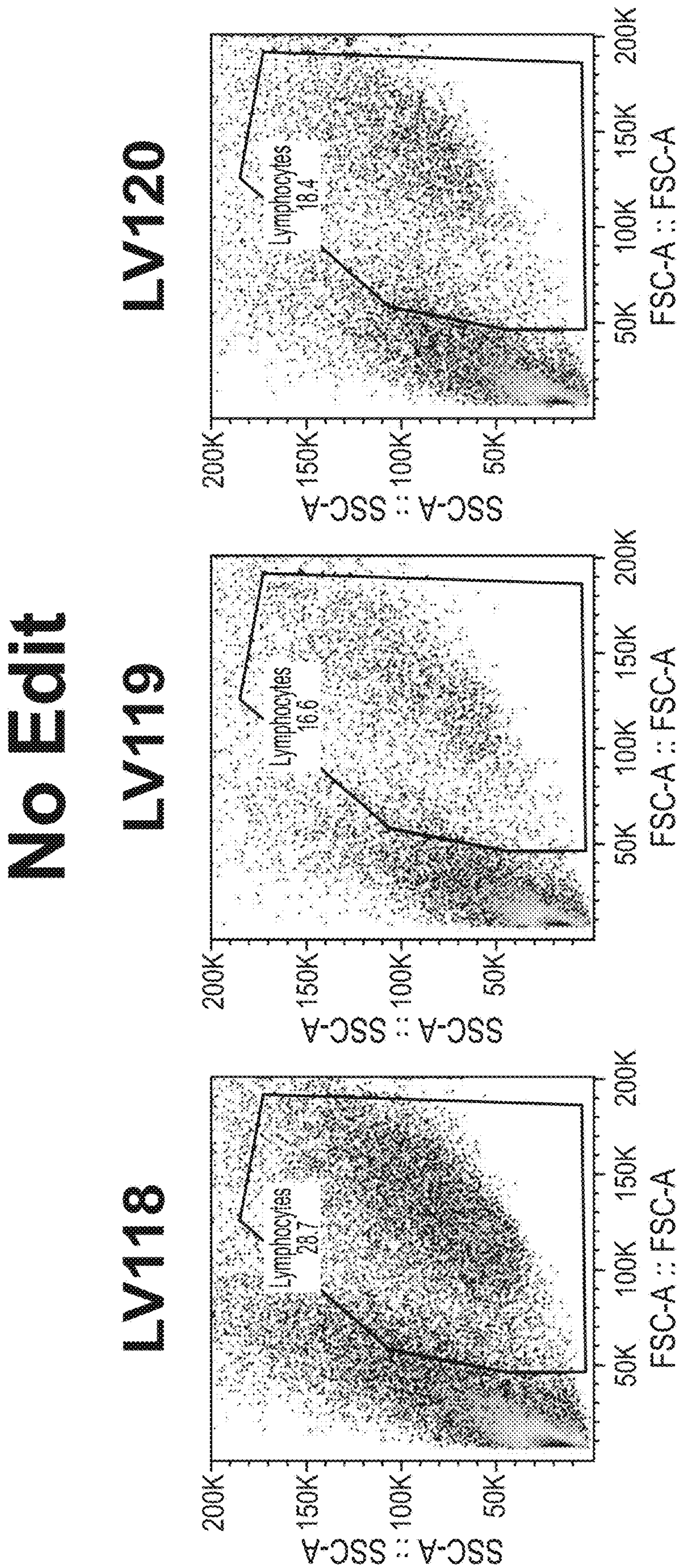
Figure 11D:
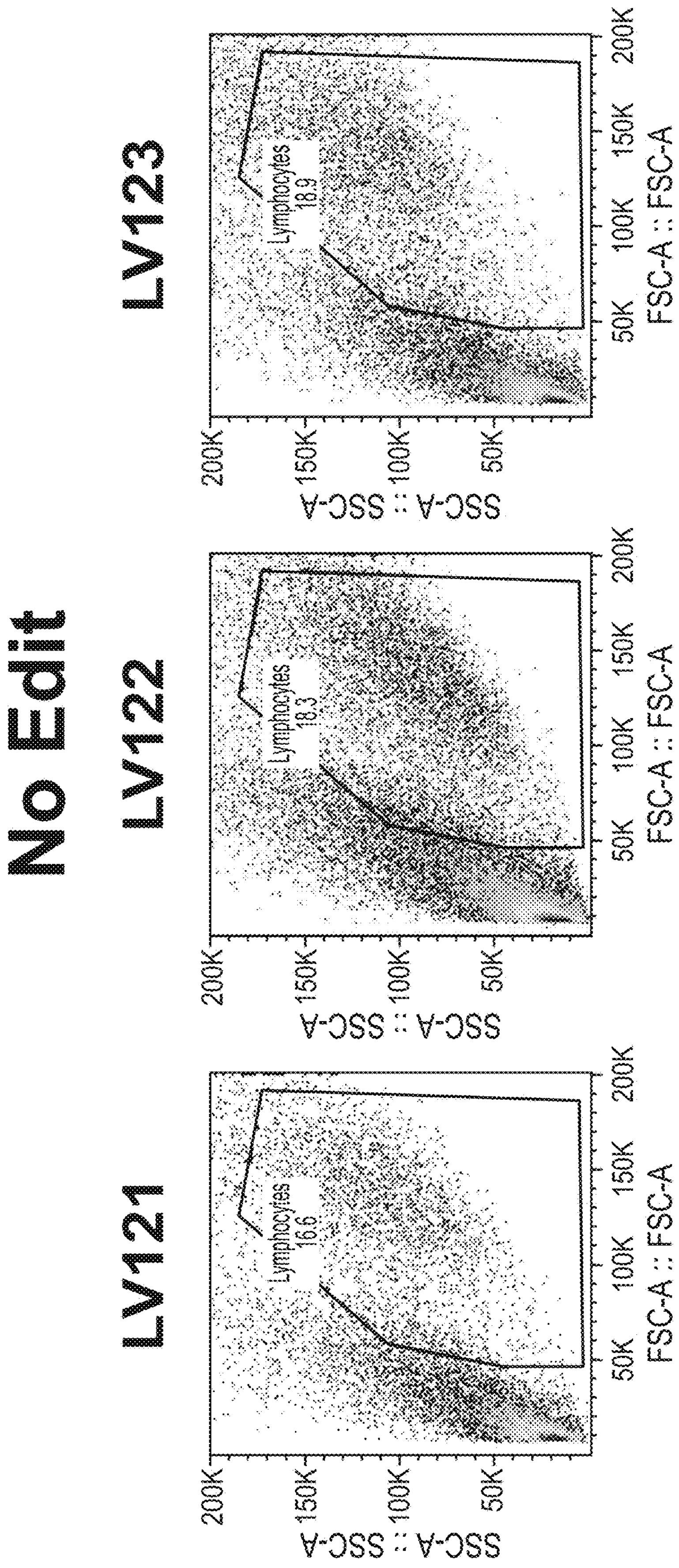

CD2 and CAR expression was evaluated in each cell population using flow cytometry 10-days post transduction (see FIGS. 7A-7E, 8A-8F, 9, 10A-10D, and 11A-11D). It was determined that anti-CD2 CAR-T cells base edited to knock out CD2 gene expression self-enriched for cells not surface expressing CD2 (FIGS. 7A-7E, 8A-8F). CAR-T cell populations where at least 50% of the cells were found to surface express the CAR were considered as demonstrating good expression of the CAR construct. Not being bound by theory, observations were made supporting the hypothesis that T cells expressing CARs with a CD28 costimulatory domain showed higher levels of apparent T cell activation in unedited cells having active CD2 expression than in unedited T cells expressing similar CARs, but with the CD28 costimulatory domain replaced with the CD2 costimulatory domain (FIG. 9). It was also found that knocking out the CD2 gene in the anti-CD2 CAR-T cells through base editing led to reduced levels of fratricide (FIGS. 10A-10D and 11A-11D). Thus, it was demonstrated that it was advantageous to knockout expression of the CD2 gene using base editing in the CD2 CAR-T cells.

Figure 12A:
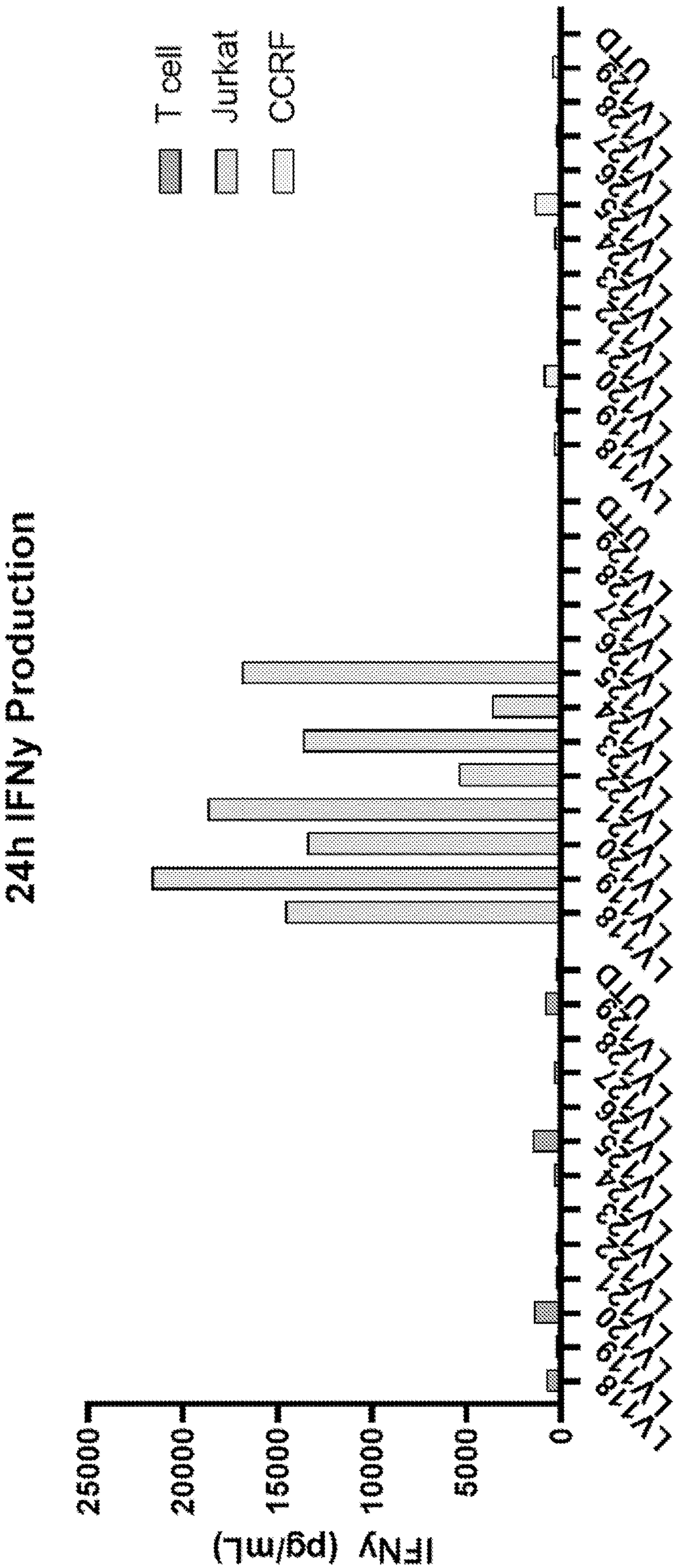
FIGS. 12A and 12B provide bar graphs demonstrating that the anti-CD2 CAR-T cells were activated in the presence of CD2+ cancer cells and showed only low levels of tonic signaling. Cells were grown in isolation or co-cultured with the indicated cancer cells. The CD2+ cancer cells were Jurkat cells (immortalized line of human T lymphocyte cells used to study acute T cell leukemia, among other things). As negative controls, the anti-CD2 CAR-T cells were grown in the absence of any cancer cells or in the presence of CD2-CCRF cells (a T lymphoblastoid cell line). To measure T cell activation, levels of interferon gamma was measured (IFN-•). Higher levels of interferon gamma (IFN-•) indicates higher cell activation. Hence.
Figure 12B:
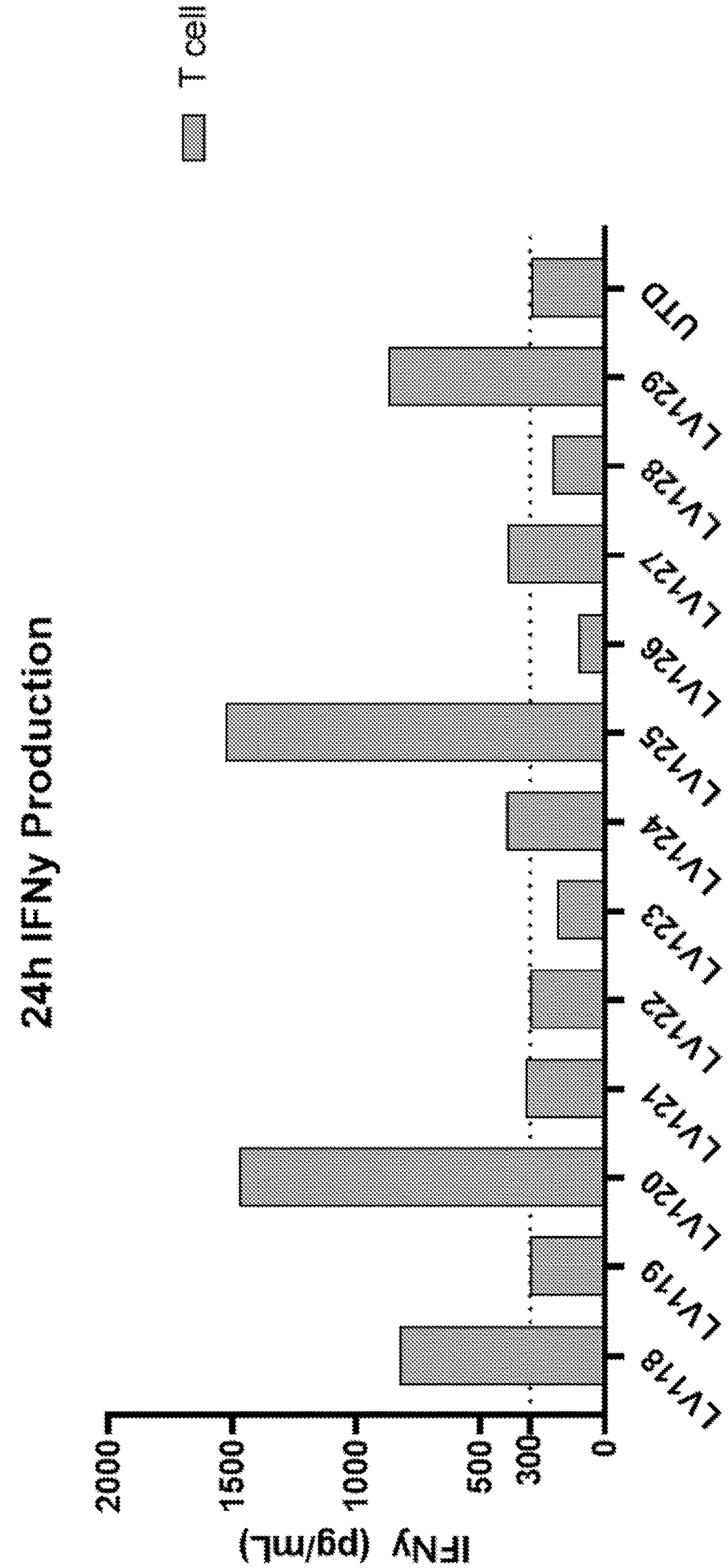

CD2 CAR-T cell stimulation and tonic activation was evaluated (FIGS. 12A and 12B). the CD2 CAR-T cells were grown in isolation or cocultured with CD2+ Jurkat cells or CD2-CCRF cells. Activation was measured by measuring levels of interferon gamma was measured (IFN-•). The CD2 CAR-T cells only showed high levels of activation in the presence of the CD2+ Jurkat cells (FIG. 12A), and only low levels of tonic activation were observed when the cells were grown in isolation (FIG. 12B).

OTHER EMBODIMENTS

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (766 sequences)

SEQ ID NO: 1 - protein, 167 aa, Escherichia coli
  misc_feature (1)..(167): TadA*7.10 (ecTadA) polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 2 - DNA, 4092 bp, Artificial Sequence
  Description of artificial sequence: BhCas12b GGSGGS-ABE8-Xten20 at P153 polynucleotide sequence
  misc_feature (1)..(6): Kozak sequence
  misc_feature (7)..(57): Sequence encoding N-terminal nuclear localization signal
  misc_feature (58)..(513): Sequence encoding BhCas12b
  misc_feature (514)..(531): Sequence encoding a linker
  misc_feature (532)..(1029): Sequence encoding TadA*8
  misc_feature (1030)..(1089): Sequence encoding Xten20 linker
  misc_feature (1090)..(3954): Sequence encoding BhCas12b
  misc_feature (3955)..(4002): Sequence encoding C-terminal NLS
  misc_feature (4003)..(4008): Seqquence encoding GS linker
  misc_feature (4009)..(4089): Sequence encoding 3x hemagglutinin (HA) tag
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatcccggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 3 - protein, 1361 aa, Artificial Sequence
  Description of artificial sequence: BhCas12b GGSGGS-ABE8-Xten20 at P153 polypeptide sequence
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 4 - DNA, 4092 bp, Artificial Sequence
  Description of artificial sequence: BhCas12b GGSGGS-ABE8-Xten20 at K255 polynucleotide sequence
  misc_feature (1)..(6): Kozak sequence
  misc_feature (7)..(57): Sequence encoding N-terminal nuclear localization signal (NLS)
  misc_feature (58)..(822): Sequence encoding BhCas12b
  misc_feature (823)..(840): Sequence encoding a linker
  misc_feature (841)..(1338): Sequence encoding TadA*8
  misc_feature (1339)..(1398): Sequence encoding Xten20 linker
  misc_feature (1399)..(3954): Sequence encoding BhCas12b
  misc_feature (3955)..(4002): Sequence encoding C-terminal NLS
  misc_feature (4003)..(4008): Sequence encoding a GS linker
  misc_feature (4009)..(4089): Sequence encoding 3x hemagglutinin (HA) tag
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaaggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 5 - protein, 1361 aa, Artificial Sequence
  Description of artificial sequence: BhCas12b GGSGGS-ABE8-Xten20 at K255 polypeptide sequence
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 6 - DNA, 4092 bp, Artificial Sequence
  Description of artificial sequence: BhCas12b GGSGGS-ABE8-Xten20 at D306 polynucleotide sequence
  misc_feature (1)..(6): Kozak sequence
  misc_feature (7)..(57): Sequence encoding N-terminal nuclear localization signal (NLS)
  misc_feature (58)..(975): Sequence encoding BhCas12b
  misc_feature (976)..(993): Sequence encoding a linker
  misc_feature (994)..(1491): Sequence encoding TadA*8
  misc_feature (1492)..(1551): Sequence encoding Xten20 linker
  misc_feature (1552)..(3954): Sequence encoding BhCas12b
  misc_feature (3955)..(4002): Sequence encoding C-terminal NLS
  misc_feature (4003)..(4008): Sequence encoding a GS linker
  misc_feature (4009)..(4089): Sequence encoding 3x hemagglutinin (HA) tag
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 7 - protein, 1361 aa, Artificial Sequence
  Description of artificial sequence: BhCas12b GGSGGS-ABE8-Xten20 at D306 polypeptide sequence
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 8 - DNA, 4092 bp, Artificial Sequence
  Description of artificial sequence: BhCas12b GGSGGS-ABE8-Xten20 at D980 polynucleotide sequence
  misc_feature (1)..(6): Kozak sequence
  misc_feature (7)..(57): Sequence encoding N-terminal nuclear localization signal (NLS)
  misc_feature (58)..(2997): Sequence encoding BhCas12b
  misc_feature (2998)..(3015): Sequence encoding a linker
  misc_feature (3016)..(3513): Sequence encoding TadA*8
  misc_feature (3514)..(3573): Sequence encoding Xten20 linker
  misc_feature (3574)..(3954): Sequence encoding BhCas12b
  misc_feature (3955)..(4002): Sequence encoding C-terminal NLS
  misc_feature (4003)..(4008): Sequence encoding a GS linker
  misc_feature (4009)..(4089): Sequence encoding 3x hemagglutinin (HA) tag
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 9 - protein, 1361 aa, Artificial Sequence
  Description of artificial sequence: BhCas12b GGSGGS-ABE8-Xten20 at D980 polypeptide sequence
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 10 - DNA, 4092 bp, Artificial Sequence
  Description of artificial sequence: BhCas12b GGSGGS-ABE8-Xten20 at K1019 polynucleotide sequence
  misc_feature (1)..(6): Kozak sequence
  misc_feature (7)..(57): Sequence encoding N-terminal nuclear localization signal (NLS)
  misc_feature (58)..(3114): Sequence encoding BhCas12b
  misc_feature (3115)..(3132): Sequence encoding a linker
  misc_feature (3133)..(3630): Sequence encoding TadA*8
  misc_feature (3631)..(3690): Sequence encoding Xten20 linker
  misc_feature (3691)..(3954): Sequence encoding BhCas12b
  misc_feature (3955)..(4002): Sequence encoding C-terminal NLS
  misc_feature (4003)..(4008): Sequence encoding GS linker
  misc_feature (4009)..(4089): Sequence encoding 3x hemagglutinin (HA) tag
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 11 - protein, 1361 aa, Artificial Sequence
  Description of artificial sequence: BhCas12b GGSGGS-ABE8-Xten20 at K1019 polypeptide sequence
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 12 - protein, 208 aa, Petromyzon marinus
  MISC_FEATURE (1)..(208): tr|A5H718|A5H718_PETMA Cytosine deaminase OS=Petromyzon marinus OX=7757 PE=2 SV=1 amino acid sequence; PmCDA1 polypeptide sequence
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 13 - DNA, 766 bp, Petromyzon marinus
  misc_feature (1)..(766): EF094822.1 Petromyzon marinus isolate PmCDA.21 cytosine deaminase mRNA, complete cds; PmCDA1 polynucleotide sequence
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 14 - protein, 145 aa, Homo sapiens
  MISC_FEATURE (1)..(145): tr|Q6QJ80|Q6QJ80_HUMAN Activation-induced cytidine deaminase OS=Homo sapiens OX=9606 GN=AICDA PE=2 SV=1; AID polypeptide sequence
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 15 - DNA, 10681 bp, Homo sapiens
  misc_feature (1)..(10681): NG_011588.1:5001-15681 Homo sapiens activation induced cytidine deaminase (AICDA), RefSeqGene (LRG_17) on chromosome 12; nucleic acid sequence of the CDS of human AID; polynucleotide sequence
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 16 - protein, 198 aa, Homo sapiens [sequence omitted]

SEQ ID NO: 17 - protein, 198 aa, Canis lupus familiaris
  MISC_FEATURE (1)..(198): Canine AID (clAID) polypeptide sequence
  MISC_FEATURE (1)..(30): Nuclear localization sequence
  MISC_FEATURE (183)..(198): Nuclear export signal
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 18 - protein, 199 aa, Bos Taurus
  MISC_FEATURE (1)..(199): Bovine AID (btAID) polypeptide sequence
  MISC_FEATURE (1)..(30): Nuclear localization sequence
  MISC_FEATURE (183)..(199): Nuclear export signal
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 19 - protein, 239 aa, Rattus
  MISC_FEATURE (1)..(239): Rat AID polypeptide sequence
  MISC_FEATURE (1)..(26): Nuclear localization sequence
  MISC_FEATURE (194)..(239): Nuclear export signal
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 20 - protein, 198 aa, Mus musculus [sequence omitted]

SEQ ID NO: 21 - protein, 229 aa, Rattus norvegicus [sequence omitted]

SEQ ID NO: 22 - protein, 229 aa, Mesocricetus auratus
  MISC_FEATURE (1)..(229): maAPOBEC-1 polypeptide sequence
MSSETGPVVVDPTLRRRIEPHEFDAFFDQGELRKETCLLYEIRWGGRHNIWRHTGQNTSRHVEINFIEKFTSERYFYPSTRCSIVWFLSWSPCGECSKAITEFLSGHPNVTLFIYAARLYHHTDQRNRQGLRDLISRGVTIRIMTEQEYCYCWRNFVNYPPSNEVYWPRYPNLWMRLYALELYCIHLGLPPCLKIKRRHQYPLTFFRLNLQSCHYQRIPPHILWATGFI

SEQ ID NO: 23 - protein, 236 aa, Pongo pygmaeus
  MISC_FEATURE (1)..(236): ppAPOBEC-1 polypeptide sequence
MTSEKGPSTGDPTLRRRIESWEFDVFYDPRELRKETCLLYEIKWGMSRKIWRSSGKNTTNHVEVNFIKKFTSERRFHSSISCSITWFLSWSPCWECSQAIREFLSQHPGVTLVIYVARLFWHMDQRNRQGLRDLVNSGVTIQIMRASEYYHCWRNFVNYPPGDEAHWPQYPPLWMMLYALELHCIILSLPPCLKISRRWQNHLAFFRLHLQNCHYQTIPPHILLATGLIHPSVTWR

SEQ ID NO: 24 - protein, 236 aa, Oryctolagus cuniculus
  MISC_FEATURE (1)..(236): ocAPOBEC1 polypeptide sequence
MASEKGPSNKDYTLRRRIEPWEFEVFFDPQELRKEACLLYEIKWGASSKTWRSSGKNTTNHVEVNFLEKLTSEGRLGPSTCCSITWFLSWSPCWECSMAIREFLSQHPGVTLIIFVARLFQHMDRRNRQGLKDLVTSGVTVRVMSVSEYCYCWENFVNYPPGKAAQWPRYPPRWMLMYALELYCIILGLPPCLKISRRHQKQLTFFSLTPQYCHYKMIPPYILLATGLLQPSVPWR

SEQ ID NO: 25 - protein, 235 aa, Monodelphis domestica
  MISC_FEATURE (1)..(235): mdAPOBEC-1 polypeptide sequence
MNSKTGPSVGDATLRRRIKPWEFVAFFNPQELRKETCLLYEIKWGNQNIWRHSNQNTSQHAEINFMEKFTAERHFNSSVRCSITWFLSWSPCWECSKAIRKFLDHYPNVTLAIFISRLYWHMDQQHRQGLKELVHSGVTIQIMSYSEYHYCWRNFVDYPQGEEDYWPKYPYLWIMLYVLELHCIILGLPPCLKISGSHSNQLALFSLDLQDCHYQKIPYNVLVATGLVQPFVTWR

SEQ ID NO: 26 - protein, 224 aa, Pongo pygmaeus
  MISC_FEATURE (1)..(224): ppAPOBEC-2 polypeptide sequence
MAQKEEAAAATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEELEIQDALKKLKEAGCKLRIMKPQDFEYVWQNFVEQEEGESKAFQPWEDIQENFLYYEEKLADILK

SEQ ID NO: 27 - protein, 224 aa, Bos Taurus
  MISC_FEATURE (1)..(224): btAPOBEC-2 polypeptide sequence
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 28 - protein, 440 aa, Mus musculus
  MISC_FEATURE (1)..(440): mAPOBEC-3-(1) polypeptide sequence
MQPQRLGPRAGMGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYISVPSSSSSTLSNICLTKGLPETRFWVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 29 - protein, 429 aa, Mus musculus
  MISC_FEATURE (1)..(429): APOBEC-3-(2) (Mouse APOBEC-3) polypeptide sequence
  MISC_FEATURE (71)..(108): Nucleic acid editing domain
  MISC_FEATURE (288)..(319): Nucleic acid editing domain
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 30 - protein, 430 aa, Rattus
  MISC_FEATURE (1)..(430): APOBEC-3 polypeptide sequence
  MISC_FEATURE (72)..(109): Nucleic acid editing domain
  MISC_FEATURE (289)..(320): Nucleic acid editing domain
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 31 - protein, 199 aa, Homo sapiens
  MISC_FEATURE (1)..(199): hAPOBEC-3A polypeptide sequence
  MISC_FEATURE (70)..(106): Nucleic acid editing domain
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 32 - protein, 373 aa, Homo sapiens
  MISC_FEATURE (1)..(373): hAPOBEC-3F polypeptide sequence
  MISC_FEATURE (65)..(99): Nucleic acid editing domain
  MISC_FEATURE (248)..(283): Nucleic acid editing domain
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 33 - protein, 370 aa, Rhesus macaque
  MISC_FEATURE (1)..(370): Rhesus macaque APOBEC-3G polypeptide sequence
  MISC_FEATURE (1)..(61): Cytoplasmic localization signal
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 34 - protein, 384 aa, Pan troglodytes
  MISC_FEATURE (1)..(384): Chimpanzee APOBEC-3G polypeptide sequence
  MISC_FEATURE (1)..(60): Cytoplasmic localization signal
  MISC_FEATURE (65)..(100): Nucleic acid editing domain
  MISC_FEATURE (257)..(291): Nucleic acid editing domain
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 35 - protein, 377 aa, Chlorocebus sabaeus
  MISC_FEATURE (1)..(377): Green monkey APOBEC-3G polypeptide sequence
  MISC_FEATURE (1)..(60): Cytoplasmic localization signal
  MISC_FEATURE (65)..(100): Nucleic acid editing domain
  MISC_FEATURE (257)..(290): Nucleic acid editing domain
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 36 - protein, 384 aa, Homo sapiens
  MISC_FEATURE (1)..(384): Human APOBEC-3G polypeptide sequence
  MISC_FEATURE (1)..(60): Cytoplasmic localization signal
  MISC_FEATURE (65)..(100): Nucleic acid editing domain
  MISC_FEATURE (257)..(291): Nucleic acid editing domain
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 37 - protein, 382 aa, Homo sapiens
  MISC_FEATURE (1)..(382): Human APOBEC-3B polypeptide sequence
  MISC_FEATURE (66)..(100): Nucleic acid editing domain
  MISC_FEATURE (251)..(289): Nucleic acid editing domain
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 38 - protein, 395 aa, Rattus
  MISC_FEATURE (1)..(395): Rat APOBEC-3B polypeptide sequence
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 39 - protein, 226 aa, Bos Taurus
  MISC_FEATURE (1)..(226): Bovine APOBEC-3B polypeptide sequence
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 40 - protein, 490 aa, Pan troglodytes
  MISC_FEATURE (1)..(490): Chimpanzee APOBEC-3B polypeptide sequence
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 41 - protein, 190 aa, Homo sapiens
  MISC_FEATURE (1)..(190): Human APOBEC-3C polypeptide sequence
  MISC_FEATURE (65)..(100): Nucleic acid editing domain
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 42 - protein, 190 aa, Gorilla
  MISC_FEATURE (1)..(190): Gorilla APOBEC-3C polypeptide sequence
  MISC_FEATURE (65)..(100): Nucleic acid editing domain
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 43 - protein, 202 aa, Rhesus macaque
  MISC_FEATURE (1)..(202): Rhesus macaque APOBEC-3A polypeptide sequence
  MISC_FEATURE (72)..(103): Nucleic acid editing domain
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 44 - protein, 185 aa, Bos Taurus
  MISC_FEATURE (1)..(185): Bovine APOBEC-3A polypeptide sequence
  MISC_FEATURE (56)..(86): Nucleic acid editing domain
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 45 - protein, 200 aa, Homo sapiens
  MISC_FEATURE (1)..(200): Human APOBEC-3H polypeptide sequence
  MISC_FEATURE (54)..(88): Nucleic acid editing domain
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 46 - protein, 210 aa, Rhesus macaque
  MISC_FEATURE (1)..(210): Rhesus macaque APOBEC-3H polypeptide sequence
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 47 - protein, 386 aa, Homo sapiens
  MISC_FEATURE (1)..(386): Human APOBEC-3D polypeptide sequence
  MISC_FEATURE (78)..(109): Nucleic acid editing domain
  MISC_FEATURE (262)..(296): Nucleic acid editing domain
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 48 - protein, 236 aa, Homo sapiens
  MISC_FEATURE (1)..(236): Human APOBEC-1 polypeptide sequence
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 49 - protein, 229 aa, Mus musculus
  MISC_FEATURE (1)..(229): Mouse APOBEC-1 polypeptide sequence
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 50 - protein, 224 aa, Homo sapiens
  MISC_FEATURE (1)..(224): Human APOBEC-2 polypeptide sequence
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 51 - protein, 224 aa, Mus musculus
  MISC_FEATURE (1)..(224): Mouse APOBEC-2 polypeptide sequence
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 52 - protein, 224 aa, Rattus
  MISC_FEATURE (1)..(224): Rat APOBEC-2 polypeptide sequence
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 53 - protein, 208 aa, Petromyzon marinus
  MISC_FEATURE (1)..(208): Petromyzon marinus CDA1 (pmCDAl) polypeptide sequence
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 54 - protein, 381 aa, Homo sapiens
  MISC_FEATURE (1)..(381): Human APOBEC3G D316R D317R polypeptide sequence
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 55 - protein, 182 aa, Homo sapiens
  MISC_FEATURE (1)..(182): Human APOBEC3G chain A polypeptide sequence
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 56 - protein, 184 aa, Homo sapiens
  MISC_FEATURE (1)..(184): Human APOBEC3G chain A D120R D121R polypeptide sequence
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 57 - protein, 367 aa, Homo sapiens
  MISC_FEATURE (1)..(367): hAPOBEC-4 polypeptide sequence
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 58 - protein, 388 aa, Rattus norvegicus
  MISC_FEATURE (1)..(388): rAPOBEC-4 polypeptide sequence
MEPLYEEYLTHSGTIVKPYYWLSVSLNCTNCPYHIRTGEEARVPYTEFHQTFGFPWSTYPQTKHLTFYELRSSSGNLIQKGLASNCTGSHTHPESMLFERDGYLDSLIFHDSNIRHIILYSNNSPCDEANHCCISKMYNFLMNYPEVTLSVFFSQLYHTENQFPTSAWNREALRGLASLWPQVTLSAISGGIWQSILETFVSGISEGLTAVRPFTAGRTLTDRYNAYEINCITEVKPYFTDALHSWQKENQDQKVWAASENQPLHNTTPAQWQPDMSQDCRTPAVFMLVPYRDLPPIHVNPSPQKPRTVVRHLNTLQLSASKVKALRKSPSGRPVKKEEARKGSTRSQEANETNKSKWKKQTLFIKSNICHLLEREQKKIGILSSWSV

SEQ ID NO: 59 - protein, 363 aa, Macaca fascicularis
  MISC_FEATURE (1)..(363): mfAPOBEC-4 polypeptide sequence
MEPTYEEYLANHGTIVKPYYWLSFSLDCSNCPYHIRTGEEARVSLTEFCQIFGFPYGTTYPQTKHLTFYELKTSSGSLVQKGHASSCTGNYIHPESMLFEMNGYLDSAIYNNDSIRHIILYCNNSPCNEANHCCISKVYNFLITYPGITLSIYFSQLYHTEMDFPASAWNREALRSLASLWPRVVLSPISGGIWHSVLHSFVSGVSGSHVFQPILTGRALTDRYNAYEINAITGVKPFFTDVLLHTKRNPNTKAQMALESYPLNNAFPGQSFQMTSGIPPDLRAPVVFVLLPLRDLPPMHMGQDPNKPRNIIRHLNMPQMSFQETKDLERLPTRRSVETVEITERFASSKQAEEKTKKKKGKK

SEQ ID NO: 60 - protein, 218 aa, Rattus norvegicus
  MISC_FEATURE (1)..(218): rAPOBEC-1 (delta 177-186) polypeptide sequence
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRGLPPCLNILRRKQPQLTFFTIALQSCHYQRLPPHILWATGLK

SEQ ID NO: 61 - protein, 218 aa, Rattus norvegicus
  MISC_FEATURE (1)..(218): rAPOBEC-1 (delta 202-213) polypeptide sequence
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQHYQRLPPHILWATGLK

SEQ ID NO: 62 - protein, 198 aa, Mus musculus
  MISC_FEATURE (1)..(198): mouse cytidine deaminase polypeptide sequence
  MISC_FEATURE (1)..(30): Nuclear localization sequence
  MISC_FEATURE (183)..(198): Nuclear export signal
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 63 - protein, 224 aa, Petromyzon marinus
  MISC_FEATURE (1)..(224): pmCDA-1 polypeptide sequence
MAGYECVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLTMHFSRIYDRDREGDHRGLRGLKHVSNSFRMGVVGRAEVKECLAEYVEASRRTLTWLDTTESMAAKMRRKLFCILVRCAGMRESGIPLHLFTLQTPLLSGRVVWWRV

SEQ ID NO: 64 - protein, 331 aa, Petromyzon marinus
  MISC_FEATURE (1)..(331): pmCDA-2 polypeptide sequence
MELREVVDCALASCVRHEPLSRVAFLRCFAAPSQKPRGTVILFYVEGAGRGVTGGHAVNYNKQGTSIHAEVLLLSAVRAALLRRRRCEDGEEATRGCTLHCYSTYSPCRDCVEYIQEFGASTGVRVVIHCCRLYELDVNRRRSEAEGVLRSLSRLGRDFRLMGPRDAIALLLGGRLANTADGESGASGNAWVTETNVVEPLVDMTGFGDEDLHAQVQRNKQIREAYANYASAVSLMLGELHVDPDKFPFLAEFLAQTSVEPSGTPRETRGRPRGASSRGPEIGRQRPADFERALGAYGLFLHPRIVSREADREEIKRDLIVVMRKHNYQGP

SEQ ID NO: 65 - protein, 209 aa, Petromyzon marinus
  MISC_FEATURE (1)..(209): pmCDA-5  polypeptide sequence
MAGDENVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLMMHFSRIYDRDREGDHRGLRGLKHVSNSFRMGVVGRAEVKECLAEYVEASRRTLTWLDTTESMAAKMRRKLFCILVRCAGMRESGMPLHLFT

SEQ ID NO: 66 - protein, 158 aa, Saccharomyces cerevisiae
  MISC_FEATURE (1)..(158): yCD polypeptide sequence
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 67 - protein, 194 aa, Artificial Sequence
  Description of artificial sequence: cytidine deaminase polypeptide sequence
MKPQIRDHRPNPMEAMYPHIFYFHFENLEKAYGRNETWLCFTVEIIKQYLPVPWKKGVFRNQVDPETHCHAEKCFLSWFCNNTLSPKKNYQVTWYTSWSPCPECAGEVAEFLAEHSNVKLTIYTARLYYFWDTDYQEGLRSLSEEGASVEIMDYEDFQYCWENFVYDDGEPFKRWKGLKYNFQSLTRRLREILQ

SEQ ID NO: 68 - protein, 192 aa, Artificial Sequence
  Description of artificial sequence: cytidine deaminase polypeptide sequence
MADSSEKMRGQYISRDTFEKNYKPIDGTKEAHLLCEIKWGKYGKPWLHWCQNQRMNIHAEDYFMNNIFKAKKHPVHCYVTWYLSWSPCADCASKIVKFLEERPYLKLTIYVAQLYYHTEEENRKGLRLLRSKKVIIRVMDISDYNYCWKVFVSNQNGNEDYWPLQFDPWVKENYSRLLDIFWESKCRSPNPW

SEQ ID NO: 69 - protein, 280 aa, Artificial Sequence
  Description of artificial sequence: cytidine deaminase polypeptide sequence
MDPQRLRQWPGPGPASRGGYGQRPRIRNPEEWFHELSPRTFSFHFRNLRFASGRNRSYICCQVEGKNCFFQGIFQNQVPPDPPCHAELCFLSWFQSWGLSPDEHYYVTWFISWSPCCECAAKVAQFLEENRNVSLSLSAARLYYFWKSESREGLRRLSDLGAQVGIMSFQDFQHCWNNFVHNLGMPFQPWKKLHKNYQRLVTELKQILREEPATYGSPQAQGKVRIGSTAAGLRHSHSHTRSEAHLRPNHSSRQHRILNPPREARARTCVLVDASWICYR

SEQ ID NO: 70 - protein, 555 aa, Artificial Sequence
  Description of artificial sequence: pYY-BEM3.1; tr|F7B644|F7B644_HORSE polypeptide sequence
MPRGRARERQRRNPMEKLDAEAFSFHFLNMEFVYDRNCSYLCYQVEGRLSGSPVLSEQGVFPNEVCGKTRRHAELCFLDWFRGRLSPDEYYCVTWFISWSPCSNCAREVAEFLKRHRNVELSIFAARLYYCRDHEQGLQSLCNRGAQLAVMLRKDFTYCWDNFVHNSGREFSPWENIDANSDLLARKLEDLLKNPMEKLHRKTFSFHFRNLKFAKGRKCSYLCYRVEGRLSGSPGLSEQGVFLNEVCDENCRHAELCFLHWFRGRLSPHADYRVTWFISWSPCSNCAREVAEFLKQHRNVELHISAARLYYWQRNKPGLRNLRSSGAQLAIMFFWDFRDCWDNFVHNSGRHFIPWKKINVNSRLLATKLEDLLKNPLEKLHPNTFSFHFCNLEFAYDRKYSYLCYQVEGRLSGSPGLSEQGVFLNEVCGKTRCHAELCFLDWFRVRLSPDEYYRVTWFISWSPCFYCAREVADFLKQYRNVKLSIFAARLYYCRDHAQGLRSLCSSGAQLAIMFFWDFRYCWDNFVHNSGREFRPWKKINVNSRLLATKLEDILK

SEQ ID NO: 71 - protein, 437 aa, Artificial Sequence
  Description of artificial sequence: pYY-BEM3.2; tr|D1LZA1|D1LZA1_PANTI polypeptide sequence
MEPWRPSPRNPMDRIDPKTFRFQFPNLRYASGRKLCYLCFQVERDYFYYNDSDWGVFRNEVHPWAPCHAEQCFLSWFRDQYPYRDEDYNVTWFLSWSPCPTCAEEVVEFLEEYRNLTLSIFTSRLYYFWHPNYQEGLCKLWDAGVQLDIMSCDEFEYCWDNFVYHKGMRFQRRNLLKDYDFLAAKLQEILSPGQQRKRDWPFPPRPGAQVDPRSWVQEVTEPGINTRRHPLHLLVSFLLPRPTMNPLQEDIFYRQFGNQHRVPKPYYYRRKTYLCYQLKLPEGTLIDKDCLRNKKKRHAEICFIDKIKSLTRDTSQRFEIICYITWSPCPFCAEELVAFVKDNPHLSLRIFASRLYVHWRWKYQQGLRHLHASGIPVAVMSLPEFEDCWRNFVDHQDRLFQPWRNLDQYSESIKRRLGKILTPLNDLRNDFRNLKLE

SEQ ID NO: 72 - protein, 440 aa, Artificial Sequence
  Description of artificial sequence: pYY-BEM3.3; tr|A0A3Q0DM17|A0A3Q0DM17_TARSY polypeptide sequence
MPMKRMYSNIYFDHFNNQRLLSGQNAPWLCFKVERVENCMLVPLETGVFGNQVSGCCGKTERPVEPTSLTRSVLVSPNPGTELRAQQPSRKGHLGKLGCVEYPSPGLALVMLGYGASTYCPDSSMYCPETCHHPEMCFLYWFEKTLSHEEQYQITWYVSWSPCVNCAEEVAEFLSVHPKVNLTIYAARLYCYQKLNHRQGLRRLCKEGACVKIMNYEEFDHCWENFVYNNYKSFKPWVKLQDNYELLATELDKILRIPMERMPQKKFRFHFQNLIAKDRNTTWLCFEVKNVRKKHPPDLLERGIFQNQVTPRINCHAEMCFLSWFLENMLLHGKRYQVTWYISWSPCSICAEEVAEFLSAHPKVSLTIYAARLYYFWVPGYRQGLRRLVEEGARVEIMNYEEFDYCWENFVSINNEPFQPWEGLHEKYGYLVTKLNNILG

SEQ ID NO: 73 - protein, 453 aa, Artificial Sequence
  Description of artificial sequence: pYY-BEM3.4; tr|A0A3Q0DNJ5|A0A3Q0DNJ5_TARSY polypeptide sequence
MEDNPEPRPRQQMDQDTFIFNFNNDPSVRGRHQTFLCYEVEHLDDDTWVPQDKYLGFLHNQPQSRSNAYCAYHAELCFLELVSSWQLDPAQRYRVTCFISWSPCSSCAQEVAAFLKKNRHVTLRILAARIYDYYQGYEDGLRTLQGVGVDITVMTSAEFGHCWNTFVDHQGSPFQPWEGLDQHSQVIWQRMQDILQVIPAKYLMEKVKYTVTVDILFKGRVPGPRYLMDQNTFTRNFINNLSVSGRRQTLLCYEVERLGGDIWVPLDQLRGFLLSQARDVLNYYQGRHAEPCFLDLVSSWQLDPAQHYRVTWFISWSPCTSCAQAVAAFLRENRHVTLRILAARIYDYHQGYEEGLRTLQRTGAHIDIMTFKEFGHCWNTFVNHKGSPFKSWTGLDQHSQALRKRLQDILHTMASSLWDQSEPKKPIPSQEVTLPESIPPSHGNRFRLVKRPS

SEQ ID NO: 74 - protein, 424 aa, Artificial Sequence
  Description of artificial sequence: pYY-BEM3.5; tr|G5AYU5|G5AYU5_HETGA polypeptide sequence
FCFLSCVHRKPIERIYKKAFRFYFRNLRCAYGRNKTFLCYEVKRERDNKVLHKGVVLNQVEPYMPLHAELRFLSWFHDTLLCPLGSYQVTLYVSWSPCSECAEELTTFLAGHRNVTMTIYVAQLYYCNWKSPNREGLKILIAEDARLRVMFYDEFLYCWRNFVKNDYNNFDPWSLLDENSRYHNRILQNILKGWGRPHRVGPEGEQTATPGGSGGHCISVFSLLRRREMTLKEETFRVQFNNAYKAPKPYRRRVTYLCYQLQEANGDPLTKGCLRTKKGYHAESRFIKRICSMDLGQDQSYQVTCFLTWSPCPHCAQELVSFKRAHPHLRLQIFTARLFFHWKRSYQEGLQRLCRAQVPVAVMGHPEFAYCWDNFVDHQPGPFEPPWAKLEYYSSCLKRRLQQILRSWGVDDLTNDFRNLQLGP

SEQ ID NO: 75 - protein, 385 aa, Artificial Sequence
  Description of artificial sequence: pYY-BEM3.6; tr|A0A2Y9QMV5|A0A2Y9QMV5_TRIMA polypeptide sequence
MLSSPQTPGTRKPMKTLAPDEFSFNFENLRLAHGRNTTFLCFQVETKAPPSLNSPDSGIFQNQDHCPSHHHAEMVFLTWFQKRLSPAQHYEVTWYMSWSPCSRCAVQVAKFLKSNSTVNLSIFVARLYYPRELETKDGLHSLWQAGAQVQIMFFQDFKYCWENFVNNEGKPFQPWKNLDENSKDWDTELKDIHRNTTDLLTEEMFYSQFYNREKKSSIPRKTYLCYQLNEPQPVKRCLHYKKGYHAVTRFIDGIVSMNLDPARSYDITCYFTWSPCNRYARKLVSFIEDYPNLRLKVYTSRLYFHWCWTNMQGLQHLQNSRVTVAVMTFRDFEYCWKNFVDNQGKPFEPWEKLDLYSQSTERRLRRILKPLTPDVLNEDFGNLHL

SEQ ID NO: 76 - protein, 381 aa, Artificial Sequence
  Description of artificial sequence: pYY-BEM3.7; tr|H0XHI0|H0XHI0_OTOGA polypeptide sequence
LSCAFRDPMNRMYPKTFCQNFEKEPCPSNQNSSWLCFEVETKNSAVFFHRGVFRNQPAPPPRAPTSVLLSQGPVKTPCHAEECFLTWIQGVLPPDHHYHVTWYVSRGPCANCANLIVHFLAMHRRVTLTIFAAHLNFFWESDFQQGLLRMDQEGVQLHIMGYEEFEYCWDNFVYNQRKQFVPWNGLNENYEFMVSTLEDILRSPLDRIRQKDFSIHFRNSLWLDDKSTWLCFEVKRTKSPVPLYRGVFRNQSPPKTPCHAEVRFFTWLQDLPPDFCCQFTWYLSWSPCADCADLVANFLAKHRNVSLTIFVARLYYYRDPEMHRGLRRMYQEGANVDIMSVIEFEYCWDNFVYNQGKQFVPWNGLNENYEFLVPRLQEILE

SEQ ID NO: 77 - protein, 337 aa, Artificial Sequence
  Description of artificial sequence: pYY-BEM3.8; tr|A0A3M0K4Y7|A0A3M0K4Y7_HIRRU polypeptide sequence
MYISKKALRRHFDPRVYPRETYLLCELQWEGSRRVWIHWIRNVPDHHAEEYFLEEVFEPRNYGFCNITLYLSWSPCCTCCSKIRDFLKRNPNVKIDIRVARLIYPDYAETRSSLRELNGLQRVSIQVMEAAGLSCIESKNHRISQVERDPKGSSSPTLFTLQDHLKLSNMTESVIQDSVSIQICYQMRILGFQCHIRWKLQPEDFQRNYSPNQIGRVVYLLYEVRWRRGSIWRNWCSNNPEQHAEVNFLENHFHHRPQTPCSITWFLSTSPCGKCSRRILEFLKSQPNVTLEIYAAKLFRHHDIRNRQGLRNLMMNGVTIYIMNLEGNPASLCLSVD

SEQ ID NO: 78 - protein, 237 aa, Artificial Sequence
  Description of artificial sequence: pYY-BEM3.9; tr|A0A3P4LUZ8|A0A3P4LUZ8_GULGU polypeptide sequence
MSFEDYEYCWETFVDHKGMYFQSWDLLRDNDLLAAELKNILRSTMNPLRQEIFYHQFGNQPRAPRPYHRRKTYLCYQLQPHEGPITARVCLQNKKKRHAEIRFIDNIRALRLDRSQTFEITCYLTWSPCPTCAKALAVFVQDHPHISLRLFASRLFIHWCWKYQEGLRLLHRSRIPVAVMRLQEFEDCWRNFVDNQDEPFQPWNKLEQYSESITRRLRRILGHPQNNLENDFRNLHI

SEQ ID NO: 79 - protein, 221 aa, Artificial Sequence
  Description of artificial sequence: pYY-BEM3.10; tr|G5BPM8|G5BPM8_HETGA polypeptide sequence
RRRIEPWQFEASFDPRQLRRETCLLSEVRWGTSPRAWRGCSLNTARHAEVSFMDRLTSEGRLRGPVRCSITWFLSWSPCGACAQAIGEFLRQHPNVSLVIYIARLFWHVDEQNRQGLRDLVTRGVRMQVMSDPEFAHCWRNFVNYSPGQEARWPQVPPVWTWLYSLELHCILLNLPPCLKISRRHHNQLTFFQLILQNCHYQAIPSPVLLASGLIHPFVTW

SEQ ID NO: 80 - protein, 211 aa, Artificial Sequence
  Description of artificial sequence: pYY-BEM3.11; tr|H2M862|H2M862_ORYLA polypeptide sequence
MITKLDSVLLPKKKFIYHYKNMRWARGRHETYLCFVVKRRVGPESLSFDFGHLRNRNGCHVELLFLRHLSALCPGLWGYGATGQGRVSYSITWFCSWSPCANCSFRLAQFLSQTPNLRLRIFVSRLYFCDLEDSREREGLRMLKKVGVHITVMSYKDYFYCWQTFVARKQSKFKPWDGLHQNSVRLSRKLNRILQPCETEDFRDAFKLLGL

SEQ ID NO: 81 - protein, 353 aa, Artificial Sequence
  Description of artificial sequence: pYY-BEM3.12; tr|H0Y0C6|H0Y0C6_OTOGA polypeptide sequence
MYLKTFYRHFNNRPYLSRRNDTWLCFEVKTTSSNSPGSFYSGVFRNQGPRYCPWHTELCFLTWVRPIVSHHHFYQITWYMSWSPCANCAWQVATFLATHENVSLTNYTVRIYYFWRQDYRQGLLRMIEEGTQVYVMSSKEFQHCWENFVDHWGTRWVTCWNRLKKNYEFLVTRLSEILSDPKERISPNTFYNQFNNTPVPRGRKDTWLCFEVKEKNSNSPGSFHRGVFQNQVFSGTSSHARRCPPDHHYEVTWYTSWSPCAHCAWHVVNFLTSNPNVSLTIFAARLYYIYRPEIQQGLRRVFQEGAKVHIMSLKEFKYCWAKLVYNSGMRFMPWYQFNFNFLFPNTTLKGDLH

SEQ ID NO: 82 - protein, 189 aa, Artificial Sequence
  Description of artificial sequence: pYY-BEM3.13; tr|A0A3Q2Z5X6|A0A3Q2Z5X6_HIPCM polypeptide sequence
MDVHFMNFIYHYKNMRWAKGRNETYLCFVVKRRVGPNSLTFDFGHLRNRNGCHVELLFLRYLGRRLSYSITWFCSWSPCANCSAALSQFLSRMPNLRLRIFVARLYFCDMEDSHEREGLRLLQKAGVQVTVMSYKDYYYCWQTFVDRKKSHFKAWEDLHQNSVRLSRKLNRILQPCEMDLRDAFKLLGL

SEQ ID NO: 83 - protein, 190 aa, Artificial Sequence
  Description of artificial sequence: pYY-BEM3.15; tr|A0A2K6NY90|A0A2K6NY90_RHIRO polypeptide sequence
MNPHIRNPMEAMYPGTFYFHFKNLWEADNRNESWLCFAVEVIKHHSTVSWKRGVFRNQVDPETHCHAEKCFLSWFCDNTLSPKKNYQVTWYTSWSPCPECAREVAKFLARHSNVMLTIYTARLYYSQYPNYQEGLRRLNEEGVPVEIMDYEDFKYCWENFVYNGDELFKPWKGLKYNFLFLDSKLQEILE

SEQ ID NO: 84 - protein, 202 aa, Artificial Sequence
  Description of artificial sequence: pYY-BEM3.16; tr|Q6ICH2|Q6ICH2_HUMAN polypeptide sequence
MNPQIRNPMERMYRDTFYDNFENEPILYGRSYTWLCYEVKIKRGRSNLLWDTGVFRGPVLPKRQSNHRQEVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 85 - protein, 202 aa, Artificial Sequence
  Description of artificial sequence: pYY-BEM3.17; tr|G8GPV1|G8GPV1_CERNE polypeptide sequence
MDGSPASRPGHVMDPGTFTSNFNNKPWVSGQRETYLCYKVERSHNDTWVLLNQHRGFLRNQAKNRLHGDYGCHAELCFLGEVPSWRLDPTQTYRVTWFISWSPCFSGGCAEQVRAFLQENTHVRLRIFAARIYDYDFLYQEALRTLRDAGAQVSIMTYEEFKHCWDTFVDHQGRPFQPWDGLDEHSQALSGRLQAILQNQGN

SEQ ID NO: 86 - protein, 181 aa, Artificial Sequence
  Description of artificial sequence: pYY-BEM3.18; tr|Q1WBT6|Q1WBT6_SYMSY polypeptide sequence
MALLTAKTFRLQFNNKRRVTKPYYPRKALLCYQLTPQNGSTPTRGYFKNKKKRHAEIRFINKIKSMGLDETQCYQVTCYLTWSPCPSCAWELVDFIKAHDHLNLGIFASRLYYHWCRHQQEGLRLLCGSQVPVEVMGFPEFADCWENFVDHEEPLSFNPSEMLEELDKNSRAIKRRLEKIK

SEQ ID NO: 87 - protein, 211 aa, Artificial Sequence
  Description of artificial sequence: pYY-BEM3.19; tr|A0A3B4CS14|A0A3B4CS14_PYGNA polypeptide sequence
MDNTNRRKFIYHYKNVRWARGRHETYLCFVVKKRNSPDSLSFDFGHLRNRNGCHVELLFLRYIEVLCPGLWGSGVDGVRVSYAVTWFCSWSPCSNCAQRLTNFLSQTPNLRLRIFVARLYFCDEEDSLEREGLRHLQRAGVQITVMTYKDFFYCWQTFVASRERCFKAWEGLRQNSVRLSRKLNRILQVFISTPVISPLITTHLGQSWAGG

SEQ ID NO: 88 - protein, 315 aa, Artificial Sequence
  Description of artificial sequence: pYY-BEM3.20; tr|A0A087XZI4|A0A087XZI4_POEFO polypeptide sequence
RKVSYSVTWFCSWSPCANCSIRLAQFLHQTPNLRLRIFVSRLYFCDLEDSREREGLRILKKAGVHITVMSYKDYFYCWQTFVAKSQSKFKPWDGLHQNYIRLSRKLNRILQPALDIKKFIYHYKNLRWARGRCETYLCFVVKKKLHLFMFVIVGRNRLFDLNVTMNNKSLYLIPLHLQLLFLRHLGALCPGLWGYGVTGERKVSYSVTWFCSWSPCANCSIRLAQFLHQTPNLRLRIFVSRLYFCDLEDSREREGLRILKKAGVHITVMSYKDYFYCWQTFVAKSQSKFKPWDGLHQNYIRLSRKLNRILQVQFF

SEQ ID NO: 89 - protein, 189 aa, Artificial Sequence
  Description of artificial sequence: pYY-BEM3.21; tr|A0A341AEK4|A0A341AEK4_9CETA polypeptide sequence
MASDRGPSAGDATSRRRIEPWEFEVSFDPRELCKETRLLYEIKWGRSQHVWRHSGKNTTNHVECNFIEKFTSERPFHRSVSCCITWFLSWSPCWECSKAIREFLNQHPRVTLFIYVARLFQHMDPQNRQGLRDLIHSGVTIQIMGPTEYDYCWRNFVNYPPGKEAHWPRYPPPLMKLYALELHCIILVP

SEQ ID NO: 90 - protein, 180 aa, Artificial Sequence
  Description of artificial sequence: pYY-BEM3.22; tr|E2D879|E2D879_MUSMI polypeptide sequence
RNLISRETFNFNFENLCYAKGRKNTFLCYEVTRKDCDSPVSLCHGVFKNKGSIHAEICFLYWFHDKVLKVLTPREEFKVTWYMSWSPCFECAEQVVRFLATHHNLNLTIFSSRLYNVSDPDTQQKLCRLVQEGAQVAVMDLSEFKKCWEKFVDNDGQQFRPWKRLRTNFRYQNSKLQEIL

SEQ ID NO: 91 - protein, 221 aa, Artificial Sequence
  Description of artificial sequence: pYY-BEM3.23; tr|A0A2K5RDN6|A0A2K5RDN6_CEBCA polypeptide sequence
MWEAQSPGLSREWGSVAISPEDPGPLHIGRFLSCAFRHPMNAMYPGIFNFHFRNLRKAYGRNETWLCFTVEGIMNRSTVSWKSGVFRNQVGSDPFCHAEMCFLSWFRHNMLSPKKDYEVTWYASWSPCPECAGQVAEFLARHGNVRLTIFTAHLYYFWNPSFRQGLRRLSQEGASVLIMGYEDFEYCWDNFVYNDGQPFKPWKRLQDNSLSLYITLQEILQ

SEQ ID NO: 92 - protein, 206 aa, Artificial Sequence
  Description of artificial sequence: pYY-BEM3.24; tr|A0A2K5RDN7|A0A2K5RDN7_CEBCA polypeptide sequence
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSL

SEQ ID NO: 93 - protein, 184 aa, Artificial Sequence
  Description of artificial sequence: pYY-BEM3.25; tr|A0A1C9CJ69|A0A1C9CJ69_CERAL polypeptide sequence
NPMKAMDPHIFYFHFKNLRKAYGRNETWLCFAVEIIKQRSTVPWRTGVFRNQVDPESHCHAERCFLSWFCEDILSPNTDYRVTWYTSWSPCLDCAGEVAEFLARHSNVELAIFAARLYYFWDTHYQQGLRSLSEKGASVEIMGYEDFKYCRENFVCDDGKPFKPWKGLKTNFRFLKRRLQEILE

SEQ ID NO: 94 - protein, 197 aa, Artificial Sequence
  Description of artificial sequence: pYY-BEM3.26; tr|A0A2R2Z4D2|A0A2R2Z4D2_PTEAL polypeptide sequence
MHLQVWRKVTEAWREGYTLKPWSRNPMERLYHDYFYFHFYNLPTPKHRNGCYICYQVEGTKKHSRMPLLRGVFENQESLDMMLSPGEKYRVTWYISWSPCFACVDEVIKFLREHTNVELIIFAARLYHSDILQYRQGLRKLHDAGVHVAIMSYYEFKHCLNDFVFHQGRSFCPWNDLNKNSKNLSNTLEDILRNQED

SEQ ID NO: 95 - protein, 206 aa, Artificial Sequence
  Description of artificial sequence: pYY-BEM3.27; tr|B7T161|B7T161_SHEEP polypeptide sequence
MTEGWAGSGLPGRGDCVWTPQTRNTMNLLRETLFKQQFGNQPRVPPPYYRRKTYLCYQLKELDDLMLDKGCFRNKKQRHAEIRFIDKINSLNLNPSQSYKIICYITWSPCPNCASELVDFITRNDHLNLQIFASRLYFHWIKPFCRGLHQLQKAGISVAVMTHTEFEDCWEQFVDNQLRPFQPWDKLEQYSASIRRRLQRILTAPT

SEQ ID NO: 96 - protein, 205 aa, Artificial Sequence
  Description of artificial sequence: pYY-BEM3.28; tr|A0A2R2X2G4|A0A2R2X2G4_PTEAL polypeptide sequence
MAGLGQACEGCCGQMPEISYPMGRLDPKTFSFEFKNLPYAYGRKSSYLCFQVEREQHSSPVPSDWGVFKNQFCGTEPYHAELCFLNWFRAEKLSPYEHYDVTWFLSWSPCSTCAEEIAIFLSNHKNVRLNIFVSRIYYFWKPAFRQGLQELDHLGVQLDAMSFDEFKYCWENFVDNQGMPFRCWKKVHQNYKSVLRKLNEILRRR

SEQ ID NO: 97 - protein, 309 aa, Artificial Sequence
  Description of artificial sequence: pYY-BEM3.29; tr|G1Q1M4|G1Q1M4_MYOLU polypeptide sequence
YAELSFLDLFQSWNLDRGRQYRLTWYMSWSPYPDCAQKLVEFLGENSHVTLRIFAADIHSLCSGYEDGLRKLRDARAQLAIMTRDELQYCWVTFVDNQGQPFRPWPNLVEHIKTKKQELKDILGNPMRRMYPKTFNFNFQNLNSYGRKSTFLCFEVETWEDGSVLDYQNGVFQNQLDPGHAELCFIEWFHEKVLFPDEVRCPDAQYHVTWYISWSPCFECAEQVAGFLNEHENVDLSISAARLYLCEDEDEQGLQDLVAAGAKVAMMAPEDFEYCWDNFVYNRGWPFTYWKHVRRNYGRLQEKLDEILW

SEQ ID NO: 98 - protein, 216 aa, Artificial Sequence
  Description of artificial sequence: pYY-BEM3.30; tr|A0A1S3AN78|A0A1S3AN78_ERIEU polypeptide sequence
RRIEPWEFEDFFDPRQFRPETCLLYEVRWGSSRNAWRSTARNTTRHAEVNFLERFAAERHFDKPVSCSITWFLSWSPCWECSQAIGAFLSQHPQVTLAIHVTRLFHHEDEQNRQGLRDLLARGVTLQVMGDSEYAHCWRTFVNSPPGAEGHYPRYPSDFTRLYALELHCIILGLPPCLEILRRYQNQFTLFRLVPQNCHYQMIPHLNFFVVRHYFF

SEQ ID NO: 99 - protein, 201 aa, Artificial Sequence
  Description of artificial sequence: pYY-BEM3.32; tr|Q4VUI3|Q4VUI3_XENLA polypeptide sequence
MTMDSMLLKRNKFIYHYKNLRWARGRHETYLCYIVKRRYSSVSCALDFGYLRNRNGCHAEMLFLRYLSIWVGHDPHRNYRVTWFSSWSPCYDCAKRTLEFLKGHPNFSLRIFSARLYFCEERNAEPEGLRKLQKAGVRLSVMSYKDYFYCWNTFVETRESGFEAWDGLHENSVRLARKLRRILQPPYDMEDLREVFVLLGL

SEQ ID NO: 100 - protein, 191 aa, Artificial Sequence
  Description of artificial sequence: pYY-BEM3.33; tr|E2RL86|E2RL86_CANLF polypeptide sequence
MNPLQEETFYQQFSNQRVPKPTYQRRTYLCYQLKPHEGSVIAKVCLQNQEKRHAEICFIDDIKSRQLDPSQKFEITCYVTWSPCPTCAKKLIAFVNDHPHISLRLFASRLYFHWRQKYKRELRHLQKSGIPLAVMSYLEFKDCWEKFVDHKGRPFQPWNKLKQYSESIGRRLQRILQPLNNLENDFRNLRL

SEQ ID NO: 101 - protein, 226 aa, Artificial Sequence
  Description of artificial sequence: pYY-BEM3.34; tr|G1LWB0|G1LWB0_AILME polypeptide sequence
SSAAPASIHLLDEDTFTENFRNDDWPSRTYLCYKVEGPDQGSGVPLGQDKGILHNKPAQGPEPSRHAECYLLEQIQSWNLDPKLHYGVTCFLSWSPCAKCAQKMARFLQENSHVSLKLFASRLYTRERWDEDYKEGLRTLKRAGASIAIMTYREFEHCWKTFVLHDQEGSCFQPWPFLHKESQKFSEKLQAILQVGVLLLSLPPPLPSSPLSSPWPFPAPLRASTG

SEQ ID NO: 102 - protein, 238 aa, Artificial Sequence
  Description of artificial sequence: pYY-BEM3.35; tr|A0A1U7S7K7|A0A1U7S7K7_ALLSI polypeptide sequence
MGEHWQYAGSGEYIPQDQFEENFDPSVLLAETHLLSELTWGGRPYKHWYENTEHCHAEIHFLENFSSKNRSCTITWYLSWSPCAECSARIADFMQENTNVKLNIHVARLYLHDDEHTRQGLRYLMKMKRVTIQVMTIPDYTYCWNTFLEDDGEDESDDYGGYAGVHEDEDESDDDDYLPTHFAPWIMLYSLELSCILQGFAPCLKIIQGNHMSPTFQLHVQDQEQKRLLEPANPWGAD

SEQ ID NO: 103 - protein, 220 aa, Artificial Sequence
  Description of artificial sequence: pYY-BEM3.36; tr|A0A2R2X2J8|A0A2R2X2J8_PTEVA polypeptide sequence
MPRIGNMNLLSEKTFNYHFGNQLRVKKPQGRRRTYLCYKLKLPNETLVKGYFINKKKNHAEIRFINKIRSLNLDQTQSYKITCYITWSPCSYCAGKLVALVKSCPHLSLQIFTSRLYYHWLWKNQAGLRYLWKINISVLVMKEPEFADCWDNFVNHQSRRFKPWEKLTQYSNSTERRLLRILRINRTDLFLAQSSEQDPGLNDLVDAIKRLFLDAHRPRD

SEQ ID NO: 104 - protein, 198 aa, Artificial Sequence
  Description of artificial sequence: pYY-BEM3.37; tr|A0A151P6M4|A0A151P6M4_ALLMI polypeptide sequence
MAVEEEKGLLGTSQGWKIELKDFQENYMPSTWPKVTHLLYEIRWGKGSKVWRNWCSNTLTQHAEVNCLENAFGKLQFNPPVPCHITWFLSWSPCCQCCRRILQFLRAHSHITLVIKAAQLFKHMDERNRQGLRDLVQSGVHVQVMDLPDYRYCWRTFVSHPHEGEGDFWPWFFPLWITFYTLELQHILLQQHALSYNL

SEQ ID NO: 105 - protein, 158 aa, Artificial Sequence
  Description of artificial sequence: pYY-BEM3.38; tr|A0A2K6MNR2|A0A2K6MNR2_RHIBE polypeptide sequence
IWLCFTMEIIKQCSTVSWKRGVFRNQVDPETHCHAERCFLSWFWEDTLSPNTNYQVTWYTSWSPCLDCAGEVAEFLARHSNVKLAIFAARLYYFWDTDYQQGLRSLSEEGTSVEIMGYEDFKYCWENFVYNGDEPFKPWKGLKYNFLFLDSKLQEILE

SEQ ID NO: 106 - protein, 182 aa, Artificial Sequence
  Description of artificial sequence: pYY-BEM3.40; tr|F1CGT0|F1CGT0_ANOCA polypeptide sequence
KAAILLSNLFFRWQMEPEAFQRNFDPREFPECTLLLYEIHWDNNTSRNWCTNKPGLHAEENFLQIFNEKIDIKQDTPCSITWFLSWSPCYPCSQAIIKFLEAHPNVSLEIKAARLYMHQIDCNKEGLRNLGRNRVSIMNLPDYRHCWTTFVVPRGANEDYWPQDFLPAITNYSRELDSILQD

SEQ ID NO: 107 - protein, 230 aa, Artificial Sequence
  Description of artificial sequence: pYY-BEM3.41; tr|C7AGG3|C7AGG3_HORSE polypeptide sequence
MDPQAPTQRGGLGQAYQGGDYVQAPGNGNTQHLLSEDVFKKQFGNQRRVTKPYYRRKTYVCYQLKLLRGPTIAKGYFRNKKKRHAEIRFIDKINSLGLDQDQSYEITCYVTWSPCATCACKLIKFTRKFPNLSLRIFVSRLYYHWFRQNQQGLRQLWASSIPVVVMGYQEFADCWENFADNRGNPFQSWEKLTEYSKGIKRRLQKILEPLNLNGLEDAMGNLKLGSVDLG

SEQ ID NO: 108 - protein, 197 aa, Artificial Sequence
  Description of artificial sequence: pYY-BEM3.42; tr|A0A250YMK7|A0A250YMK7_CASCN polypeptide sequence
MSLLKEDIFLYQFNNQQQVQKPYFRRRTYLCYQLEQPNGSRPQWPAKGCLQNKKGHHAEIRFIKRIHSMGLEQDQDYQITCYITWSPCLACACALAELKNHFPRLTLRIFASRLYFHWIRKFQMGLQHLYKSGVLVAVMSLPEFTDCWEKFVNHRQVFFTPWDKLEEHSRSIQRRLRRILQSWDVDDLTDDFRNLRL

SEQ ID NO: 109 - protein, 189 aa, Artificial Sequence
  Description of artificial sequence: pYY-BEM3.43; tr|B7T160|B7T160_SHEEP polypeptide sequence
MPWISDHVARLDPETFYFQFHNLLYAYGRNCSYICYRVKTWKHRSPVSFDWGVFHNQVYAGTHCHSERRFLSWFCAKKLRPDECYHITWFMSWSPCMKCAELVAGFLGMYQNVTLSIFTARLYYFQKPQYRKGLLRLSDQGACVDIMSYQEFKYCWKKFVYSQRRPFRPWKKLKRNYQLLAAELEDILG

SEQ ID NO: 110 - protein, 541 aa, Artificial Sequence
  Description of artificial sequence: pYY-BEM4.1; tr|A0A182D0J1|A0A182D0J1_BLAVI polypeptide sequence
MTNPESPPQAPCDFNEDALLNREPLRGSPIKFVSPVDYPDLVFALAGPVGVDIDYIQQSISDCLKSFDYSTEFIRITEIMQDIKCSKTIDCTDMLKEYQSKIEYANELRRAYRAKDLLAALTISAISKLREQIKERDEATNKSNIQPSRRKLAWVVRQLKTPEEVRLLRAVYGKQFVLVSIYSSPQRREDFLISKIKIKSRGTIDNNTSSEGAQRLIERDSKEDNEYGQNLSGTFCLGDIFVDSNNKESAIVSIDRFLNAFFGSNEISPTRDEYGMYLAKTASLRSCDLSRQVGAAIFSKTGEIISLGSNEVPKAGGGTYWTGDNADSRDIRLGHDPNEINKVEIFAEIISRLLEDKLLSNDLLNKDAASIVTILLSKNEGKRYKDLRVMDIIEFGRIIHAEMSAICDAARNGRAIIGATLFCTTFPCHLCAKHIVASGIGRIVYLEPYPKSYAKKLHSDSIQVEDHSDSEKVSFEPFIGISPSRYRELFEGGRRKDPFGEALKWKNDPRKPVIDVVVPPHFEAEKLVIAQLGKLIVSGTG

SEQ ID NO: 111 - protein, 330 aa, Artificial Sequence
  Description of artificial sequence: pYY-BEM4.2; tr|A0A2D6EXD2|A0A2D6EXD2_9ARCH polypeptide sequence
MIIGLVGTIGAGKQTIIDYLQEKYGYNALSCSDVLREILKKQGKPVTRDNLREIGNKTREEGGNGAIAKILLEKLRNNWKANYIVDSLRHPDEVSVLRTSPLFHLVAVDADLRIRFERVKARKREEEPTTLPAFVERDQKEMFGTGNEQRIRETMELADELVLNNGTVEELKQRIDDLNLVSDERLRPSWDDYFMRLARLAAQRSNCMSRKVGAIITKDRRVIATGYNGTPRGVKNCNEGGCERCNSAVAKGTAISECLCLHGEENAIIEAGRVRSEGATIYTSFLPCLWCTKMIIQAGLKEVVFSEVYDLHEASIKLFETSGVLIRRLK

SEQ ID NO: 112 - protein, 367 aa, Artificial Sequence
  Description of artificial sequence: pYY-BEM4.3; tr|F7YVM7|F7YVM7_9THEM polypeptide sequence
MNEFKYMSLALKLAKKGKYTTSPNPMVGAVIVKDGKILATGYHKKAGQPHAEINALSKLNFQAQNCEMYVTLEPCSHYGRTPPCADAIIRSGIRKVVIATLDPNPLVNGKGVEKLKNAGIEVVCGVLEEKAKKLNEKFFKYITTKIPFVALKIAQTLDGKIALKNGESKWITSEKSREYVHKLRMEYDAVLTGIGTILKDDPQLNVRLKKVYKQPLRIILDSKLKIPLSAKVLEDPSKVIILTTALADKEKLEELRSKGVEVIITNEKNGIVDLESALKILGEKKITSVMVEAGPTLLTSFLKESLFDKIYLFIAPKIFGADSKSVFSELGLEDISKSQKFSLESVKKIGEDLLLELYPKQLKKLEE

SEQ ID NO: 113 - protein, 449 aa, Artificial Sequence
  Description of artificial sequence: pYY-BEM4.4; tr|A0A3M6UNF1|A0A3M6UNF1_9CNID polypeptide sequence
MEEKSELENELMRSTSPKPSVPNGSKGNECEQRETRITKENLYMVLALWMEEFPVVEQTSSAKRLNKVGVVFVLPTDRVLAADCSRDGVHGVARVMVNHCGKLEGCKVFVSRKPCSLCAKLLVQSKVSRVFYLPIEPESENKGEIARADNLFKNSSVGQSVFVPCVEQKVLDKLEDKLPKEIITPDDISECRDNLLKKCGWSAEWFARAQASLPWPCFEGKMKSQVDNDFKSLIKWIAVVKAPMDKGVAFPKVKLTSDSRVVPDCDADNFPDSKTAYHMMIFAKMLARQTDDPKTGVGAVIVRGKVPDIVSLGWNGFPSKALYGEFPRASDDDRALQKKFPYVIHAEQNALMVRNVKDLTDGILFVTKPPCDECAPMIKLSGVKTIVIGEKIEKSRGGELSYNLIKEYIKEGIMTCYQMEATKTKAKRLASDPETRKRLKSSCSNSNDV

SEQ ID NO: 114 - protein, 414 aa, Artificial Sequence
  Description of artificial sequence: pYY-BEM4.5; tr|A0A2G3K826|A0A2G3K826_9BURK polypeptide sequence
MTKIIDDVNTAAAAVLDQATAAANQTTFAVGGVMVNNQTGEVISAIHNNVIIPLSNNVSFTFDPTAHGERQLVYWYYANKEALKLPEPNQITVITSLDPCAMCTGALLTAGFNVGVVAIDTYAGINCAQNFQFATLPANLRTKAQKNFGYYASGAANFKPLTRSYVGGPSVAFKNGVVTPANLRDCGTVFTQSVDTVRNTSNSTGLAPSQMSNPAELPSNSAILQAYRAIYKKAFTIKIDNPRLPDAQILTELKAVLADAPNARNAVAFIDPFGNLVLCMADAFNTSPVHAAFMNVTQEYAKTRWDLMNKYAQASTTDNPALYLTHPKYGTFVYLYAPDPDDSITIMSLGAYGSTMEGPIPNMFPSNLQFYYPPRNGAQFSELVPVVNELPPFYTQNVNISLMQVPGVTQAPTK

SEQ ID NO: 115 - protein, 308 aa, Artificial Sequence
  Description of artificial sequence: pYY-BEM4.6; tr|K1ZCJ4|K1ZCJ4_9BACT polypeptide sequence
MSSRAKKNRSTNLKKSIGQKSIENKPTDQKKDQVLVAYVPVIHEGYRRFFRHFPAVKELWLISQELSHELRSLQKDIRALKASETKKLLQTWGQFQKIKLLTPSSLAILQKTTTQLVFPDEEISHHLVEKYFAQNRVLFASFFLRWDKKSSLKKHDLQEYSEISNKEFDQMMIAIAQQEADKSDDWWRQVGGLIFKDETILLLAHNQHTPTEAEAYFAGDPRADFHQGEYLKISTAIHAEAYLIAQAAKQGISLEGADLYVTTFPCPVCAKQVAYSGIKRVFFREGYSLLDGETILKANGVKLIRVTV

SEQ ID NO: 116 - protein, 615 aa, Artificial Sequence
  Description of artificial sequence: pYY-BEM4.7; tr|A0A1G3PNQ8|A0A1G3PNQ8_9SPIR polypeptide sequence
MRDLPLLVLGLTGPMGAGCTRFARDISKMEPGKVIKKQGLLDQVAHEISELSKKASEIRLQCISNGKNSELAELKRLNRRLNAKLAERACLHVIAKSSLPEPLFISLNTIVIKIAVDSITAPEFAEWAKNHAKVADLLKWLRTQWESELTLYETWGQDAGRFSQDELEKMDAMFAEFERIGDEILKEDFETYFGKRNNDFSIRMFSENIRLSGNPFRPAENGGGGGKYDEPSMVMIARETDRYIRFYRTRSDQKRSHFFIIDEIKNPREAEYFRARHQNFFLVSIFSSSEIRASRMRRGLGHDAGVSDADFQHLFRELDSRDWGADDFDAHGLHRQNIYRCFNLADIAINNDVEDERFSEVLFNKFIRYYALMLSPGCVQPTPQETYMHLAYSLSLRSTCISRQVGAVITDLEDRILSLGWNEVPEGQIGCGLKVKKDYTDKENPLFEMEIWDNVITAEDLAVWDDEDSICVKDILSRIEIKTKLKSVSLTPEERADVLKALRIKRLEYSRSLHAEENAILQVASRGGVGLKDGTIYVTTFPCELCSKKIYQVGISKIYYTEPYPNSISEKVILKDGIRNIKILQFEGVKSYSYFKLFKPGFDKKDAQMLEGRGI

SEQ ID NO: 117 - protein, 291 aa, Artificial Sequence
  Description of artificial sequence: pYY-BEM4.8; tr|A0A1G0PGF4|A0A1G0PGF4_9BACT polypeptide sequence
MKHNNQLRKEIEKLLGQNSIIKNDELKKLQKEYKIETDELLISFLPYAAEFAKVPISKYKVGAVVLGKSGNIYFGSNMEFEAGALSATVHAEQSAVNNAWLNGETGINKIAVTAAPCGYCRQFLNELTTAKQLHVLLKDKNLEAAKVFKLTELLPEAFGPRDLEIEGGLMKVENHKLKIENINDELINAALEAANKSYAPYSKNYSGVSIQLSDGTIFSGRYSENAAYNPSLLPFQSALAFMNMNTKKGSNNKIVDAVLVEAVSNISQKDAAGTLLNSISKTKLRYYKIKN

SEQ ID NO: 118 - protein, 398 aa, Artificial Sequence
  Description of artificial sequence: pYY-BEM4.9; tr|A0A0P4WGY5|A0A0P4WGY5_9EUCA polypeptide sequence
MEENSSATSQPKCASRTKQGGNDLSTDMSNLSVGETKRTDFLPWDDYFMAVAFLSAMRSKDPSSQVGACIVNADKKIVGIGYNGMPIGCSDDELPWNKESLDPLQTKYMYVCHAEMNAIMNKNSSDLAGCCVYVALFPCNECAKLVIQAGIREVVFFSDKHQQKPETVASKKMLNMAGVAYRQYTPSQSKIELNLSLKEQEKSEPTADITQSSERDQNSKRKDYLSWEEYFMAMAHLSALRSKDPITQVGACIVNSKKKIVGIGYNGMPLGCNDDLMPWGNSSSNKLETKYMYVCHAGVNAIMNKNSCDVSGCTLYVALFPCNECAKVIIQAGIKTIIYASDTNKDQASILASKKMLDMAGIKYRADNLSQRKIVIDFKTIDWNSRFMNDHQNDPTCL

SEQ ID NO: 119 - protein, 259 aa, Artificial Sequence
  Description of artificial sequence: pYY-BEM4.10; tr|A0A3D8IG27|A0A3D8IG27_9HELI polypeptide sequence
MRKNILYFILTLFFLSGLYATSLPEDNVVSGVIYEKIDTVSAEVDHIYPMLALAIVYKDWQEKNMLNKQGHNIGLVIVDENNMPVFWVRNSVHATHNGTQHGEVRLVSNLLNCEGFNKYLDKYTLYTTLEPCIMCAGMLSMVQIPKVVYAQKDLSCGNTQEIISTAKYPRYYKAFTVENGYKKDLEECFEQYKICKNDSITDFLVNDSAKEIFRKASNDLQDYKVKFKENRRVIKVAQEFLQNIQTKDNLDVLQCPKNM

SEQ ID NO: 120 - protein, 256 aa, Artificial Sequence
  Description of artificial sequence: pYY-BEM4.11; tr|A0A351C8C4|A0A351C8C4_9BACT polypeptide sequence
MNELTKQSEHLRNEALRIATRSYVPYTGQQEGVIILLENGDLIPGVRVENASFQLTIPALQNALSTMYALQRTDISMIVSSIPFTDSDLAYTGGMAEIAWEMVGASLLLVAGAHIPEAGTFIDPARGENLLDVSREAALNAFIPESDFPVGSAIQTSDDVVIDGCNVEHSDWSKIICAERNVLSTARSYGLGQITTIYVSCPKEPGGTPCGACRQVIVELAPDATVWMDRGNQEPIAMKATKLLPGHFTGNVLKKQ

SEQ ID NO: 121 - protein, 301 aa, Artificial Sequence
  Description of artificial sequence: pYY-BEM4.12; tr|A0A1G6V2K7|A0A1G6V2K7_PEPNI polypeptide sequence
MPIVRVNEIGARLPEDWEALETAIWQAYVSREDLPDAGELDLTLVDDATIQELNKTHRQLDKSTDVLSFPMYDDRDDLAADVQAGLPVILGDIMISVPTAERQAQAYGHSFKREMAYLLVHGLLHIAGYDHMSAEEKSAMRRAEEAILADVDVPRDTAPSKTAAVLDEADVQALIDAARAARLQAYAPYSGYAVGAALLAADGRRFCGVNVENASYGATCCAERTALFAAVTAGARDFIALALVTEGDEPAPPCGLCRQALAEFSPDLAIYLAGPTGETYRRTSLAALFPEAFSLSTKESV

SEQ ID NO: 122 - protein, 528 aa, Artificial Sequence
  Description of artificial sequence: pYY-BEM4.13; tr|F2NP91|F2NP91_MARHT polypeptide sequence
MPVMETHALEARFKEALARLCPEGRLLAAVSGGGDSVALLYLLKAAGRDTIVAHLDHALRPDSAADAAFVEKLAQRLGFPLETEHVDVRALAHRKRINLEAAAREVRYAFLARVARRWKARCILTAHTLDDNAETVLLQILRGAGRGLGIRPLQRRVARPLLEFSRAELRAYLEARGARWLEDPTNRSLELDRNYLRHAVLPRITARFPHALEALARFSQAQQADDWALEALSARHLIPDRRWPVPAYRALPLERAPEALRRRAIRGVLEALGVRPEARLVADVEAALGGRAQTLPGGVVVRRQRGTLFFIPPTVRFPKVQPPAGLEARPPRPGDYLVFPYGRKRLVDFLNERGVPRELKRRWPVGAVGAEVRWVYGLWPEPDEDRYMRRALVLARAAARQGEVPIGAVLVRDGAVLAEAANAVEASRDATAHAELLALRTALRRVGEKVLPGATLYVTLEPCPMCYGAILEARVARVVYGVENLKAGAFTVHGLEPRVALEAGRVEGECAKVLKDFFARLRPGRDGA

SEQ ID NO: 123 - protein, 226 aa, Artificial Sequence
  Description of artificial sequence: pYY-BEM4.14; tr|A0A316TX77|A0A316TX77_9BACT polypeptide sequence
MINGYTPYSGNQNTCYVKGESGTFYPGVRIENVSYPLTISSVQAAVCSCLANSDNPVEYYTGDHQPELLQVWADEYDMKPGGKLPDSPLKLFDPLVPSIPDIKKELDVLTEKSVTPNSGFPVSALLQTEKGYIRGVNIELSSWALGLCAERVAISRALTAGYTQFKSIHIYAPEADFVSPCGACRQVLLEVMPDADTELYHGDGTLSKHIVSDLLPFGFTSHKLKK

SEQ ID NO: 124 - protein, 321 aa, Artificial Sequence
  Description of artificial sequence: pYY-BEM4.15; tr|R6VYG3|R6VYG3_9FIRM polypeptide sequence
MIHKGTQTIETKRLILRAFTPDDAEAAFENWMSDPKVTEFLRWKTHADISDSRKIVNEWANGSADPEFYQWAIVPKDVNEPIGTISVVDRNDALGIFHIGYCIGSKWWHKGITSEAFSAVIHFLFEEVGANRIESQHDPENIHSGDVMKKCGLTFEGTLRQADFNNRGIVDACVYSILQSEWQNNTSVWQRLYNAALTVQNDRVVSPFIDAGGVAAALMTKKGNIYTGICIDTASTLGMCAERNAVANMLTNGESRIDKIVAVMPDGKVGAPCGACREYMMQLDRDSGDIEILLDLETEKTVRLKDLIPDWWGAERFGDTE

SEQ ID NO: 125 - protein, 229 aa, Artificial Sequence
  Description of artificial sequence: pYY-BEM4.16; tr|A0A3C1HZ18|A0A3C1HZ18_9BACI polypeptide sequence
MGDIMENWNELSEPWKRCFLQAWKAYCHGSIPIGAVLVDSEGEIFLEGRNRVHELTAPEGQLCDCRIAHAEMNVLVQVKTSDYEKLSGATIYSTMEPCIQCFGAIILSRIKNISFAAIDDKLAGATTLEDRHGFIKSRNLNIAGPFSHLGEIQIILRTDFLLRIFDSEYADPLIAAHEKDYPIGVALGRHYHRNNRLQVAKKETIPFGELFNEFSFDIKRAREGYTLGK

SEQ ID NO: 126 - protein, 205 aa, Artificial Sequence
  Description of artificial sequence: pYY-BEM4.17; tr|A0A1M6KV24|A0A1M6KV24_9BACT polypeptide sequence
MEASQQNILLKIEGKGPVAEINFTVTLPEWLVEQVQSGSTVFLTQKEKMRFVLELARKNVAQETGGPFAAAVFSLESGELVSAGVNVVVESRCSSAHAEVVALSLAQKAVDSHDLGAAGLPRMVLVSSAEPCAMCMGAIPWSGVKQVICGARDEDVRSVGFDEGAKPLEWVEDFAERGIEVIRDVLREEATEVLWDYRERGGEIY

SEQ ID NO: 127 - protein, 207 aa, Artificial Sequence
  Description of artificial sequence: pYY-BEM4.18; tr|A0A2U0T9B4|A0A2U0T9B4_9RHIZ polypeptide sequence
METAELISRLLDVIEKDIAPVTAKGVARGNKLFGAAILKKSDLAVIVAETNNEIENPLWHGEMQAIKRFFELPADQRPATRDCLFLATHEPCSLCLSGITWSGFDNFYYLFSHQDSRDGFAIPYDIQILKSVYAVPEPETGTVSPARDLYNRSNDFWTSHGLQDMIAGLARSNREALLARIDDLNALYAELSERYQRDKGGKGIPLP

SEQ ID NO: 128 - protein, 231 aa, Artificial Sequence
  Description of artificial sequence: pYY-BEM4.19; tr|A0A2K9PN08|A0A2K9PN08_9FLAO polypeptide sequence
MSDKKESKIKISKTSESIELDEIHSLLSYSIVQKFWENDDRNGRGYNVGVILVDENKNIVDWDINSVNKTENSTQHGEMRLISRYLDKDELYSLKGYTMYPTLEPCAMCAGMMTMTNVYRTVNGQMDYFYSKALERLSIDTRECGGYPPYPRTVISEISPSSISTRLDAEYKQYTNAGNKPIITKFLSTYKAKTIYDDAFNQFINFKCKFPENKTKYENAIKFYNSLPESI

SEQ ID NO: 129 - protein, 330 aa, Artificial Sequence
  Description of artificial sequence: pYY-BEM4.20; tr|F4PWM7|F4PWM7_CAVFA polypeptide sequence
MRFSLSLLFVILSVLLAGVLACKDPYNPETVDYGQCASATKANYEVRSDSKVLTPADLPADELAVHESRMRHIIDIARVNNKKFVSSIYFPNGTLACIGINTGKPNMIAHGEIVAIQNCTEIHGISMYTNYSIYTTGEPCSMCASAILWSRFKTVVWSTYNSDLYCKICMSNIPIDSSYIFSRAYGLGIEAPVAIGGVVKAEGDAWFGTYCNRPTSIYYIAPKCACQDPAKVSPLKFTQTRTTVWVEGGDKVVTQWNAIISNPSNSTIVDPPIVISPSVVFKGAPWGISAASEPNTYKLSYNKVLFPGQTFSFGYSVYGLEEVAFTALEA

SEQ ID NO: 130 - protein, 193 aa, Artificial Sequence
  Description of artificial sequence: pYY-BEM4.21; tr|U7QZM1|U7QZM1_PHOTE polypeptide sequence
MNKTRRKLLATLGIMSISMSFIAQAGEKKTQVINNILSKQEITEHEKYMREAIKEAIKNPKHPFGAVIVNRNNGEILSRGVNTGRNNPILHGEIQAINHYITQYGNQGWENVALYTTGEPCSMCMSALVWIGIREVIWATSISVIRNSGIRQIDISAHEIAERASSFYNPITLVGGILANETDKLFLERKRGN

SEQ ID NO: 131 - protein, 319 aa, Artificial Sequence
  Description of artificial sequence: pYY-BEM4.22; tr|A0A081CH48|A0A081CH48_PSEA2 polypeptide sequence
MASRRHLLATQVTGNHRKLSLWHLRGWLSPYTKLVDAVYFLTTNSFYHSLQTPPVQSITMLLSSIITSLALAAQASAYREGLHPEFQSGLSINSVPATDRDHWMRLANSAIYYPPVSHPCPQAPFGTAIVNTTSNELICAIANRVGSTGDPTQHGEITAIQHCTNVMRKKGLSPQEIIAAWKQLSLYTNAEPCTMCLSAIRWAGFKEVIYGTSVGTISENGRNQIYIPSNLVLEKSYSFGHATLMLGNILTHETDPFFQHQFNESAPCPVGCERTQVGEARVKTCEPVPNWQKLVRLEYSEDSRVGSEPVAHTPLHLEL

SEQ ID NO: 132 - protein, 203 aa, Artificial Sequence
  Description of artificial sequence: pYY-BEM4.23; tr|A0A3D3HMU1|A0A3D3HMU1_9GAMM polypeptide sequence
MDYSDAILGAITSIRRNSKQPGVNVTDNVTDSSTQYNNDEYWMRRALALAREAGEAGEIPVGAVLVKDNQQVAGGFNQPIRSHDPAAHAEILTLREAGAVLGNYRLIDTTLYVTLEPCMMCAGALVHSRIKRLVFGAAEPKTGAAGSFIDLLTLPRLNHYMEVTGGVLGEECSVLLSDFFRRRRAEKKALKRQNSESGSDSAS

SEQ ID NO: 133 - protein, 270 aa, Artificial Sequence
  Description of artificial sequence: pYY-BEM4.24; tr|A0A1N5WT13|A0A1N5WT13_9ACTN polypeptide sequence
MLEKIERRLVAAAEAVVRSPSTGDAHTVAAAAMDANGDIYSGVNVFHFTGGPCAELVVIGSAAAANAPPLITIVAVGDGDRGVIAPCGRCRQVMLDLHPDVFVIVPTGDGQLAAKPVRELLPFGYVARTGSTAPRVVYFHPRHYDTISSGLKTATVRFQDSVQTGPAVFVFDDGESIRRLDAVVEKVESRRLDHLTEEDAHHEALPDSDALRDAIKTQYPMLGDGDVVDVATFRLTAISAPDPDPRSSYPPAVSRCNPAGPRADLLVGQS

SEQ ID NO: 134 - protein, 257 aa, Artificial Sequence
  Description of artificial sequence: pYY-BEM4.25; tr|X0SAC5|X0SAC5_9ZZZZ polypeptide sequence
MTKDGRVIASAHDTEVTDQDSTAHAEINAIRKASKIYRKDLTGCLIISTHEPCPMCTGSIIWSNISKVVYGVSIRDSIKAGRDMINLSCKEIIKKPNAEINIYDGILKKECLKLYNNDTRKLVKKFRKYEWINIEENLLNKRMQWFENNKTMIRKLKGNDLEKAYHLILMKIGIKRSEAPIVKKSESKIIFHSKNYCPSLEACIILDLDTREVCKEIYERPTEELIRRLNSKLRFTRNYDCIRPYSDYCEEIIILEK

SEQ ID NO: 135 - protein, 154 aa, Artificial Sequence
  Description of artificial sequence: pYY-BEM4.26; tr|A0A3B8IC10|A0A3B8IC10_9BACT polypeptide sequence
MPSHEDFIHQCLELGKEALLQGNPPVGSVIVWQDQVIGRGIENGRSSGDITQHAELLALQEAVATGQRDKLKEAIIYSTHEPCVMCAYPIRQYKIPTVVYSVAVPELGGHTSSWHLLTTEDVPKWGKAPKIITGISAEEVEALNAAFQDSLKKG

SEQ ID NO: 136 - protein, 180 aa, Artificial Sequence
  Description of artificial sequence: pYY-BEM4.27; tr|A0A2N9P8B9|A0A2N9P8B9_9FLAO polypeptide sequence
MFIFKLISPPVSIEVYQDKIIQKLYICFMENIFTDEYFMKKALQEAETAFQQGEIPVGAVIVIDNRIIARSHNLTEMLNDVTAHAEMQAITASANFLGGKYLKDCTLYVTLEPCQMCAGALYWSQISKIVYGATDEQRGYRAMGAQLHPKTKVISGIMQNECTHLMKDFFKQRRSKSTKD

SEQ ID NO: 137 - protein, 178 aa, Artificial Sequence
  Description of artificial sequence: pYY-BEM4.28; tr|K1KX30|K1KX30_9BACT polypeptide sequence
MVKNPVNNNELYFGKHSEIPMNEEQKAYMKMAVDLSRSGMESGKGGPFGCVIVKDGKVIGIGSNSVLETNDPTAHAEIVAIRDACRNLGHFQLDGCEVYTSCEPCPMCLGAIYWARPSKVFFANDKRDAAEAGFDDDFIYQELELPYEKRKIPFEQGMQDTAKEVFQEWILKEDKTLY

SEQ ID NO: 138 - protein, 196 aa, Artificial Sequence
  Description of artificial sequence: pYY-BEM4.29; tr|R4XI84|R4XI84_TAPDE polypeptide sequence
MSSEIEPPSTDVHKHAVAEAADESGAADAFMQIALQQAETALLNKEVPVGCVFVHQPTGTVLATGANQTNASLNGTLHAEFVAIESILRDHPPSIFRESDLYVTVEPCVMCASALRQLQVRKVYFGCGNDRFGGCGSVFSIHSDASKTGDAAYMVESGIFRKEAIMLLRRFYLLQNESAPKPALKSTRVLKEHFDE

SEQ ID NO: 139 - protein, 212 aa, Artificial Sequence
  Description of artificial sequence: pYY-BEM4.30; tr|A0A239CVF7|A0A239CVF7_9DELT polypeptide sequence
MSPASKKHFPSLFSFLLLTIGLICGTAHAQPQGHTADDTAATLANASLKEHEPFIRRCYQLAIDAGKKGNHPFGALLVHKGKIVLEAENTVLTDNDFTNHAEMNLIAEAARTLSRQIIPEATVYTSCAPCAMCTATLAMAGFTRIVYGVSHDALNKRFGLKGKSVSCPALFKTMGMELEFVGPVLEKEGLRVFDFWPEKDPHAQMLKKQARK

SEQ ID NO: 140 - protein, 320 aa, Artificial Sequence
  Description of artificial sequence: pYY-BEM4.31; tr|A0A1Q3NME1|A0A1Q3NME1_9BACT polypeptide sequence
MTEFNYDWAKLAFSSKRPLTNLKATFIIAPREISEKRFTQLLKEYLPKGDILLGISKEDYVEGLEGQPQFAMLQQKTLQKLIDKVNDASAHKVYTLRYFQRELPAIIEKLTPPRVVGIHGSWHHSFHTLPIYYLLSEKRIPYQLVAAFSDEDEARAYEVATDKKIVRPTLEGSFDDTTVLQLTDEVAKSSYDYGFQTGAILAEKVNGVYQPVAAGFNKVVPYQTYALLNGASRETNFSPANDMNHYDTIHAEMQILVEAAKQGISLKDKTLFVNLMPCPSCARTLSQTELSEIVYRIDHSGGYAVDLLTKVGKDIRRIVY

SEQ ID NO: 141 - protein, 180 aa, Artificial Sequence
  Description of artificial sequence: pYY-BEM4.32; tr|A0A2G6N4N7|A0A2G6N4N7_9DELT polypeptide sequence
MKERTVSYSDRHFMAEALEMAESALTQGEFPVGCVIADGTAVVARGHRTGTTAGAVNEIDHAEINALRHLGLAGEHLDRTDLTIYSTMEPCLMCFAAIVLSGINRIVYAYEDVMGGGTGCDLTGLPPLYRDAPLTLVAGVRRRASLNLFRRFFTDPENGYWAGSLLSRYTLNQTKDSHRL

SEQ ID NO: 142 - protein, 156 aa, Artificial Sequence
  Description of artificial sequence: pYY-BEM4.33; tr|A0A0G0RBB8|A0A0G0RBB8_9BACT polypeptide sequence
MQSVQYNKLTHLQRRALDEAEQVLENSYNPYSHFYVGACLISEDEQLIAGTNFENAAYGSAICAERAAVLRANAMSIRRFRGIAIIARGEDFNTTEVTGPCGSCRQVLYEISQVSGCDLQVILATSKKDKIVITTIRELLPLAFGPLDLGVDIGKY

SEQ ID NO: 143 - protein, 217 aa, Artificial Sequence
  Description of artificial sequence: pYY-BEM4.34; tr|A0A327L2Q5|A0A327L2Q5_9RHIZ polypeptide sequence
MVTSRDGEDEAMMARCVALSRIAVGKGEYPFGAVVAREGRIVAEAINRTIRDGDVSRHAEVIALARAQKAIGRRELRECSLYSNVEPCAMCSYCIREAWVGRVVYALGSPVMGGVSKWNILRDDGLSGRMPQVFDAAPEVVSGVLVEQAQAAWRDWSPLAWEMITLRGLMTDPSARPECRTRAARPRSLWHHLVALIERPPRPYVDPTSAAEGHADL

SEQ ID NO: 144 - protein, 162 aa, Artificial Sequence
  Description of artificial sequence: pYY-BEM4.35; tr|S2DR30|S2DR30_9BACT polypeptide sequence
MKMKKKIEITVSLEVIQKSEWSKEDRSLIERAIHAVEHAHAPYSNFMVGTALLLDNGQIFSANNQENVSFPVGICAERAVLSYAMGNFPNNRPVKLAVVAKRRSDSTWATVTPCGLCRQTINEYEVKFGHPIEILMLNPGEEILKASGIDQLLPFRFNDLNS

SEQ ID NO: 145 - protein, 153 aa, Artificial Sequence
  Description of artificial sequence: pYY-BEM4.36; tr|A0A369QGF1|A0A369QGF1_9BACT polypeptide sequence
MEEHEKWMHWCLNLAQQALQQGDFPVGAVVVQKGKLIGQGVEAGQLKKDITCHAEMEAIRDARQTINTADLQNCILYSTHEPCIMCSYVIRHHKISRVVVGTTVPEVGGSSSAYPLLSAPDISIWVAPPHLVTGVLAEACQALSQAYKQKFKK

SEQ ID NO: 146 - protein, 159 aa, Artificial Sequence
  Description of artificial sequence: pYY-BEM4.37; tr|A0A1W6X4U4|A0A1W6X4U4_9RHIZ polypeptide sequence
MTNPSRQERWDRRFLELAKVFGTWSKDRSAGTGCVIVGPDRLLRASGYNGFARGIDDEVPERHERPAKYSWTEHAERNAIYNAAKLGISLDGCTAYVNWFPCIDCARAIVQAGIVRLVGLHPDHADQRWGSEFKFATEMLRESGIEIILYDIPELAARK

SEQ ID NO: 147 - protein, 490 aa, Artificial Sequence
  Description of artificial sequence: pYY-BEM4.38; tr|A0A238BW09|A0A238BW09_9BILA polypeptide sequence
MEEMARKIRTKAKKANSYCNTMTFLISKASIVLLKAECKRIELTVVIFRFLIKMNASEPNNELCDMTVIKSMLKITHVIFDLDGLLIDTEVVFSKVNQCLLSKYNKKFTPHLRGLVTGMPKKAAVTYILEHEKLSAKVDVDEYCKKYDEMAEEMLPKCSLMPGVMKLVRHLKTHSIPMAICTGATKKEFEIKTRYHKELLDLISLRVLSGDDPAVKRGKPAPDPFLVTMDRFKQKPEKAENVLVFEDAANGVCAAIAAGMNVIMVPDLTYMKIPEGLQNKINSFSDNLIISNDLNVALMSLKKELSEEEVHFLNRAFEIAVDAVLNNEVPVGCVFVFEGQEVAFGRNDVNRTKNPTYHAEMVALKMMKQWCMDNGRDLEEIMRRTTLYVTLEPCIMCASALYHLRLKKILYGAANERFGGLVSVGTREKYGAKHFIEIMPNLSVDRAVKLLKEFYEKQNPFCPEEKRKVKKPKKSGNNNDNSDDAVALNV

SEQ ID NO: 148 - protein, 159 aa, Artificial Sequence
  Description of artificial sequence: pYY-BEM4.39; tr|A0A1J5H6Z0|A0A1J5H6Z0_9BACT polypeptide sequence
MAYQPSEKFMQMAIDKTREGVLSGQTPFGACIVKDGKVVACEHNTVWQDTDITSHGEVHTIRAACKAIGSIDLSGCILYSTCEPCPMCFSAIHWARIDTVVYGAFIADAQDAGFNELTISNEKMKEFGGSPVNFISGFMRDENVALFKLWKEQGANNVY

SEQ ID NO: 149 - protein, 168 aa, Artificial Sequence
  Description of artificial sequence: pYY-BEM4.40; tr|A0A3C2D945|A0A3C2D945_9BACT polypeptide sequence
MKTTEIRIIVHEYQNIDELTENDQYLLHEARRITEFAYAPYSGFHVGAAILLGNGMIVKGNNQENSAYPSGLCAERVALFYANANYPDSEVKTIAISAAKNGILVNDPIKPCGGCRQTLSEAEVRFGSPIRIILDGQDSILVLHGVESLLPLSFSKKDLASPLAATGR

SEQ ID NO: 150 - protein, 214 aa, Artificial Sequence
  Description of artificial sequence: pYY-BEM4.41; tr|A0A1I7EYS3|A0A1I7EYS3_9BURK polypeptide sequence
MKFKLDPSRPPDEDDYYLGVALAVRRKANCTGNRVAAVIVKNKRVIATGYNGVPEDMPNCLDGGCLRCSNPGGQFKSGTRYDLCICVHAEQNALLTAARFGISVEGAHLYTTMQPCFGCAKEILQAKIEKVFYLHPWVPTDVDPVMDAAMKAEYAKIIGKLKVKKLDFDDPVATWAVTTMRQAALASDKNPDKKTPPKTAKKKVAKKKSRTSPR

SEQ ID NO: 151 - protein, 155 aa, Artificial Sequence
  Description of artificial sequence: pYY-BEM4.42; tr|H8GQX8|H8GQX8_METAL polypeptide sequence
MNHEHFMRRAIELARQAPQYPFGAVIVRRDDGQCVGQGFNRSDLNPTYHGEMVAINDCAVRHCAEDWRGFDLYTTAEPCAMCQGAIEWAGIGRVFYGTSIPYLQKLGWWQIDLRAAEVSARAVFRDTLIVGGILETECNALFAAARRGCFGTGSE

SEQ ID NO: 152 - protein, 156 aa, Artificial Sequence
  Description of artificial sequence: pYY-BEM4.43; tr|A0A0S8HZN3|A0A0S8HZN3_9CHLR polypeptide sequence
MDEHDIRFLRASFDVARNARKNGNHPFGALLVDEHGRIVMEAENTVITAKDCTGHAETNLMREASSKYDSDFLANCTIYTSTEPCPMCAGAIFWSNVRRVVYGLSEESLYEIAGRGSEEVLFLSCREIFERGKKLIEVIGPLLEDEAREVHMGFWR

SEQ ID NO: 153 - protein, 193 aa, Artificial Sequence
  Description of artificial sequence: pYY-BEM4.44; tr|E3SF31|E3SF31_9CAUD polypeptide sequence
MKPTTVLQIAYLVSQESKCCSWKVGAVIEKNGRIISTGYNGSPAGGVNCCEHAEEQGWLLNKPKPVLIPGHKSECVRFSQVDRFVLAKAHREAHSAWSKNNEIHAELNAILFAARMGSSIEGATMYVTLSPCPDCAKAISQSGIKKLVYCETYDKNIPGWDDILKNAGIEVFNVPKRSLDKLNWENINEFCGE

SEQ ID NO: 154 - protein, 330 aa, Artificial Sequence
  Description of artificial sequence: pYY-BEM4.45; tr|F8AAC6|F8AAC6_THEID polypeptide sequence
MIRAPWHEYFMLLAKIVALRSGCNSRPSGAVIVKNKRILATGYNGPMPGAWHCTDRGPGYCFRREKGIPDIDKYNFCRATHAEANAIAQAARFGISVEGASLYCTLAPCYVCLKLIASAGIKKVYYEHDYGSRDFERDQFWKEAIKEAGLEKFEQITVSQEVMEQLQEILPYPTSKRRLAPTEFLDEFEDGKKYGVPSIEVLFNKLNYLTRQALKDITFVIEKTTVTEEPEGISFYLSGKMVELSELINTVKKQINADQNFYFLAKHNAIEAKIEILREAENIRLKAFLNECPLESFKRIAESLDYILYQVSNSLSLPTRLELSVNLLRI

SEQ ID NO: 155 - protein, 158 aa, Artificial Sequence
  Description of artificial sequence: pYY-BEM4.46; tr|A0A2H4ZNK4|A0A2H4ZNK4_9EUKA polypeptide sequence
MKKQLSRKIQEEWMSRLLRNAYDAGTYGEVPIAAVILNESGQCIGWGRNCREKDQNPLGHAEIIALRQASYLKKSWRFNECTMLVTLEPCPMCAGALLQARINHIIYGASDYKRGGFGGVLDLSKNSSAHHKIEITRGVKSIQSCQLLETWFRRRRRV

SEQ ID NO: 156 - protein, 176 aa, Artificial Sequence
  Description of artificial sequence: pYY-BEM4.47; tr|A0A239N5N1|A0A239N5N1_9PSED polypeptide sequence
MEGRAGIIPFDEGGAAMGPAEEDSPMQHLAYMREALALARANVEAGGRPFGAVLVRDGEVIARAANGTHLDHDPTAHAELLALRAAGRALGSPRLDGCVVYASGHPCPMCLAAMHLSGVSAAYYAYSNADGEPYGLSTAAVYAQMAQPVEWQSLPLQALRPEDEEGLYGFWRERRP

SEQ ID NO: 157 - protein, 199 aa, Artificial Sequence
  Description of artificial sequence: pYY-BEM4.48; tr|A0A328VTR2|A0A328VTR2_9PSED polypeptide sequence
MHPEHLALLQQAPASTHADDTWARLCCEQALLAVEEGCYAVGALLVDGAGELLCSGRNQVFAPAYASAAHAEMRVLDQLEAEHAQVDRRSLTLYVSLEPCLMCYGRILLAGITRVRYLARDRDGGFALRHGRLPPAWANLASGLSVVQAKADPYWLDLAEHAIGRLQDRQTLRQRVIRAWRGQRTLTDEFSSTKRTHSG

SEQ ID NO: 158 - protein, 402 aa, Artificial Sequence
  Description of artificial sequence: pYY-BEM4.49; tr|A0A103YG48|A0A103YG48_CYNCS polypeptide sequence
YIRELHASSLRRDEHEIQNPKILVIVDRLSSPSLHVSLSLSLSLVIFPPFIPLNQTPTHMENAKVVEAKDGTIAVASAFSGHQEVVQDRDHKFLTRAVEEAYKGVECGDGGPFGAVVVHKDEVVASCHNMVLKHTDPTAHAEVTAIREACKKLNKIELSDCEIYASCEPCPMCFGAIHLSRIKRLIYGAKAEAAIAIGFDDFIADALRGTGFYQKAHLEIKQADGNGAMIAEQVFEKTKAKFAIDHKFLTRAVEEAYKGVECGDGRPFGALVVHKDEVVVSCHNMVLNYTDPTAHAEITAIREACKKLNRIELSDCEMYSSCEPCPMCFGAIQISRIKRLVYGAKAEASIASGIPIGDFISDALKGTGFHEKANFEIKQADGNGAMIAEQVFERTKAMFPKR

SEQ ID NO: 159 - protein, 195 aa, Artificial Sequence
  Description of artificial sequence: pYY-BEM4.50; tr|W5M1M8|W5M1M8_LEPOC polypeptide sequence
NSSTRESRVMAQMEINGGASPPKKPGKGQSAADQDMITGLINKALQAKEFAYCPYSNFRVGAALMTNDGRVFTGCNVENACYNLGVCAERTAILKAVSEGYESFRAIAVSSDLQDQFISPCGACRQVMREFGTGWDVFLTKVDGSYVRMTVDELLPMSFGPDDLKKKKVFSLQNGHEVSTQFYTHSPCEAGENNN

SEQ ID NO: 160 - protein, 134 aa, Artificial Sequence
  Description of artificial sequence: pYY-BEM4.51; tr|A0A3N5YPZ2|A0A3N5YPZ2_9ALTE polypeptide sequence
MSNSETEHIQALVDAAQAAQKQSYSPYSSFQVGAAIFADDGNTYSGCNIENVAYPLGQCAEATAIGMMIMQGAKRIEDIMIASPNDQVCPPCGGCRQKISEFGTAETKIHMVTRSGEVSTVTLGELLPLAFDSL

SEQ ID NO: 161 - protein, 162 aa, Artificial Sequence
  Description of artificial sequence: pYY-BEM4.52; tr|A0A2A9NC86|A0A2A9NC86_9AGAR polypeptide sequence
MTNSTLSNEDRTRLIQGAFQARKKTYSPYSNFPVGAALLTTDGRIIEGANIENASYGGTICAERTAIVKAVSDGYRHFAGIAVTTKMPTRVSPCGICRQVLREFCSLDMPVLLVPGDYPQRNPVDDDGADKPGVITEGGVRETTLGALLPDSFGPENLPPRA

SEQ ID NO: 162 - protein, 163 aa, Artificial Sequence
  Description of artificial sequence: pYY-BEM4.53; tr|A0A2D6RD43|A0A2D6RD43_9GAMM polypeptide sequence
MNIENLITENDETLIRRCIELAGESVKNGDKPFGALLAKDGNIIFESSNNAKTKVPYHAEILTLMDAQDKLNTTDLSDYALYSNCEPCPMCSFMIREYKLDKVVFSVHSPYMGGQSRWNILEDDVLTRFKPYFSKPPNVVGGVLESEGKRIFDKVGLWMFGKE

SEQ ID NO: 163 - protein, 204 aa, Artificial Sequence
  Description of artificial sequence: pYY-BEM4.54; tr|A0A0H3AVL6|A0A0H3AVL6_BRUO2 polypeptide sequence
MHAKGYSQQERRIIPFANRFRFRELCSNKSLHGLRAKFPEQYTKWDPMRKAASITKANSATPMDIALEEAHAAGERGEVPIGAVIVRDGEIIARAGNRTREFNDVTAHAEILTIRQAGEMLGSERLIDCDLYVTLEPCAMCAAAISFARIRRLYYGASDPKGGGIEHGGRFYTQPTCHHAPEIYPGFCEADARKILKDFFREKR

SEQ ID NO: 164 - protein, 165 aa, Artificial Sequence
  Description of artificial sequence: pYY-BEM4.55; tr|A0A242H531|A0A242H531_9ENTE polypeptide sequence
MFIVKNNIEVIQQQAELDAKFMKQALKLAKDASNNGNEPFGAVLVKNDKVILTGENQIHTESDPTYHAELGIIRDFCTSQKITDLSEYTLYTSCEPCCMCAGAMVWSNLDRMVYGLGHDELAEIAGFNIMIGSEEIFSKSPNRPEVAKGVLKEAAVPVYVDYFQR

SEQ ID NO: 165 - protein, 181 aa, Artificial Sequence
  Description of artificial sequence: pYY-BEM4.56; tr|A0A2R6XZE2|A0A2R6XZE2_9BACL polypeptide sequence
MSGRISWHEYFMAQAKLIALRATCTRLMVGAVIVRDRRVIAGGYNGSIAGDEHCIDVGCKVRDGHCIRTIHAEQNALMQCAKFGVSTDGAELYVTHFPCLNCTKLLIQAGIRHIYYEVPYRVDPYAIELLEKAGVGTTQITVDLNAYVQVMSKVSTDPALTYVPESKAQKDEYGQSVGKIV

SEQ ID NO: 166 - protein, 173 aa, Artificial Sequence
  Description of artificial sequence: pYY-BEM4.57; tr|A0A139SHT6|A0A139SHT6_9BACT polypeptide sequence
MSEANASSESLPSRNSPVELIAEAAGKFGRRPTWDEYFMATAVLISTRSSCERLNVGCVIVTAGESHKNRIVAAGYNGHLPGSPHTSRMRDGHEQATVHAEQNAISDAARRGSSVEGCTAYVTHYPCINCAKILASAGIAKICYRLDYHNDPLVKPMLAEAGIEIVQLGEAAS

SEQ ID NO: 167 - protein, 170 aa, Artificial Sequence
  Description of artificial sequence: pYY-BEM4.58; tr|A0A261DBH2|A0A261DBH2_9RICK polypeptide sequence
MVMKKKLITVKRSTEFNNFFMEEALKQAQFALDKNEIPVGAIIVNRITNKVIAKAHNIVEQTKNPVLHAEIVAINQSCQILSSKNLSDCDMYVTLEPCVMCSGAISFARIGRLFYAANDPKQGAIENGGRFFNSKSCFYRPEIYSGFSAKISENLIKEFFYNVRYQKCNP

SEQ ID NO: 168 - protein, 146 aa, Artificial Sequence
  Description of artificial sequence: pYY-BEM4.59; tr|A0A2N0XZK6|A0A2N0XZK6_9VIBR polypeptide sequence
MTDNSLHESYMRQAFELSKSALPGCRPNPPVGCVFVKDGEVVSSGFSQPPGNHHAEAGAIAAYTGSYDGLVAYVTLEPCSFQGRTPSCAKALVRVRPEKVYVAILDPDTRNSGAGIKILEDAGIDVEVGLLGEEVASFLNPYLIRN

SEQ ID NO: 169 - protein, 159 aa, Artificial Sequence
  Description of artificial sequence: pYY-BEM4.60; tr|A0A1V5R0F9|A0A1V5R0F9_9BACT polypeptide sequence
MTKKETTKLHALDDFCMKKALLLAKRAFRADEVPVGALVVDSSNKVIGRGYNQVEKRKSQRAHAEQLAIEQACKKIGDWRLEGCTLYVTLEPCTMCMGLIKLSRIERVVFGAASPLFGYQLDKNRKSQLYKKGVIKIRKGVGKATAAALLKDFFKNKRM

SEQ ID NO: 170 - protein, 167 aa, Artificial Sequence
  Description of artificial sequence: pYY-BEM4.61; tr|A0A2W0H8Y3|A0A2W0H8Y3_9BACI polypeptide sequence
MKNNGRLDHEYFMTEALQEAKEAGQRGDLPIGAVIVHNGRIIARGSNMRKTAGIKISHAENNAMHNCAPYLMKHASECVIYTTLEPCIMCLTTLVMANIDSIVFAADDKYMNMKPFIDANSYIRDRIHQYKGGVCRGESEALLRKYSPYAAELALNGTHPHHRKGGA

SEQ ID NO: 171 - protein, 165 aa, Artificial Sequence
  Description of artificial sequence: pYY-BEM4.62; tr|A0A261BDB7|A0A261BDB7_CAERE polypeptide sequence
LYKLYIFRMTTTKANLTQFEQELVDKAVGAMEKAYCKYSGFKVGAALVCEDGEIIIGANHENASYGATICAERSAMVTALTKGHRKFKLLAVATELEAPCSPCGICRQYLIEFGDYKVILGSSTSDQIIETTTYGLLPYAFTPKSLDDHEKEAEERNHQEGEKKH

SEQ ID NO: 172 - protein, 162 aa, Artificial Sequence
  Description of artificial sequence: pYY-BEM4.63; tr|A0A2E1PHI6|A0A2E1PHI6_9GAMM polypeptide sequence
MKELLIHSWLMLNSNSKLIMERVIELSEINLKNGKIPIAAVIVDKKNYEIISESQNEDSPIGHAELLAITKALKKLNTNRLDSTNLFVTIEPCPMCAYAISKCHINRLYFGSEDEKGGGVINGPRIFESHNLKKIDYVSHCYHEKTTQLMQSFFQLKRNQQL

SEQ ID NO: 173 - protein, 133 aa, Artificial Sequence
  Description of artificial sequence: pYY-BEM4.64; tr|A0A378LUA7|A0A378LUA7_9GAMM polypeptide sequence
MDTIIKKMISNAHNTLAHSYSPYSKFSVASCICTDKDNFYTGVNVENSAYGLAICAETSAISAMVTAGEKRIKSMVVMAGTNILCSPCGACRQRIYEFSTPDTLIHLCDKNSILRTFKINELLPEAFKFDFNP

SEQ ID NO: 174 - protein, 370 aa, Artificial Sequence
  Description of artificial sequence: pYY-BEM4.65; tr|A0A139HQ78|A0A139HQ78_9PEZI polypeptide sequence
MADSLKSKPGHARHDTALIHGLSQSDVQKLSESCVDAKSKAYCPYSHFRVGCAVLLANGDVVQGANVENAAYPVGTCAERVALGTAVGAKKGDFRALAVSTDISPPASPCGMCRQFIREFCELNTPILMYDKDGKSVVMTLEQLLPMSFGPDKLLPPGQLENGLMQTQTQSSFVTRAFSTTSSRRQDDTPQVPQSHYDFFPQTFPQGPPPKTSFSPDLKQLRKEFLQLQAKAHPDLAPQDQKRRAEALSMRINEAYKTLQSPLRRAQYLLSQQGIDVEDETAKLDDSSLLMEVMEAREAVEEVEDEEQLNEIRAENNGRIEESVRVLEDAFRDNEFEKAAQEAIRLRYWVNIEESIQGWEKGNGGGILHH

SEQ ID NO: 175 - protein, 165 aa, Artificial Sequence
  Description of artificial sequence: pYY-BEM4.66; tr|A0A2A9FXV0|A0A2A9FXV0_9VIBR polypeptide sequence
MCNLKENKDMDKYFHFACDATIEGMREGTGGPFGATLTRNGEVVCSVANTVLKDMDISGHAEMVAVREACKKLDTLDLSDCVMYATCEPCPMCVSVMLWAGIKTCYYASTHLDAAKHGFSDQQLRDYLDGSDTSTLNMVHIEDNRDDCAKIWTEFRHLNETKNDG

SEQ ID NO: 176 - protein, 509 aa, Artificial Sequence
  Description of artificial sequence: pYY-BEM4.67; tr|A0A1A8AG96|A0A1A8AG96_NOTFU polypeptide sequence
MEHSDRWSRAEPGLSTSSRETRDGSTQTDCKLQGHGPRLSKVNLFTLLSLWMELFPQEQDEENGQSQIRRSGLVVVREGKVVGLHCSGADLHAGQAAILQHGASLANCQLFFSRRPCATCLKMIINAGVRQITFWPGDPEISMLTSNQTHSQRTSQSITEASLDATAVEKLKSNSRPQICVLMQPLAPGVLQFVDETSRRSDFMERMMDDDPELDSEKLFNSDRLRHLKDFCRHFLIQTDQRHKDILSQMGLKNFCVEPYFSNLRSNMTELVEVLAAVAAGMPQQHYGFYREESLSLDPHPVDVSQAVARHCIVQARLLSYRTEDPKVGVGAVIWAKGQSACCCGTGRLYLIGCGYNAYPAGSKYAEYPQMDNKQEDRERRKYRYIVHAEQNALTFRTRDIKPDECSMLFVTKCPCDECIPLIRGAGVKHIYTSDQDRDKDKGDISYLRFGSLKGVCKFIWQRSPPVSSASSLHLTNGCVGKHVRQAEQQIYKNKKLCTKGSSGSSDIC

SEQ ID NO: 177 - protein, 148 aa, Artificial Sequence
  Description of artificial sequence: pYY-BEM4.68; tr|A0A3E2VN88|A0A3E2VN88_9FIRM polypeptide sequence
MEKEITNMDKQKLIQMAVDGLGRSYAPYSHFHVSAALLCADGTVYTGNNIENAAYTPSVCAERCAIFKAVGDGRREFEAIAVCGGPDGVIEDYCPPCGVCRQVMREFCDPSSFRVLVAKTAEDYREYTLEQLLPDGFGPDHLTGSGER

SEQ ID NO: 178 - protein, 221 aa, Artificial Sequence
  Description of artificial sequence: pYY-BEM4.69; tr|A0A2D5ZRJ2|A0A2D5ZRJ2_9BACT polypeptide sequence
MARPVHLHTGERRTEEGATESRAVAAVATAITRAPRAPPRPATGRERDGPPPRRVFGGGLRVGDPSGYDRGESKPIGGPLTEKRSDWHSYFMRIAGEVATRATCDRKHVGAVIVRNRTILSTGYNGSIRGMPHCDDVGHDMVDGHCIATIHAEANAILQAARNGVMIQDGSIYITASPCWNCFKLVANAGLKRVYYGEFYRDKRSFEVARRLGIDLMHIEV

SEQ ID NO: 179 - protein, 155 aa, Artificial Sequence
  Description of artificial sequence: pYY-BEM4.70; tr|A0A1B8WPS3|A0A1B8WPS3_9BACI polypeptide sequence
MEGVQLIYQFQWGNLIMTVNKEDLYLIDVARNTIKTLYVDGKHHVGAAVRTKTGKIYSAVHLEANIGRVSVCAEAIALGKAISEGESEFDTIVAVRHPDPTQENQKIEVVSPCGICRELISDYGKGTNVILKNKEGYIKTVISDLLPNKYIREDN

SEQ ID NO: 180 - protein, 156 aa, Artificial Sequence
  Description of artificial sequence: pYY-BEM4.71; tr|A0A1W5ZQK9|A0A1W5ZQK9_9BACI polypeptide sequence
MNRFMERAVSLAAENVRVGGQPFGAVLVKDDELVAEGVNEMHLNYDVSGHAELLAIRRAQGELQTHDLSGYTMYASGEPCPMCLSAMYFAGIKDVFYCATVEEAAQVGLEKSKNVYDDLQKSKGERSLVMKQMPLEDDQEDPMKLWDERTNHNGTS

SEQ ID NO: 181 - protein, 340 aa, Artificial Sequence
  Description of artificial sequence: pYY-BEM4.72; tr|A0A378V0W4|A0A378V0W4_MYCFO polypeptide sequence
MVHAQFDPTARQALAATAVEAKTRKDLTWQQIADAAELSPAFVTAAVLGQHALPARSAEAVAALLGLDDDAALLLQTIPIRGSIPGGIPTDPTIYRFYEMLQVYGTTLKALVHEQFGDGIISAINFKLDVRKVADPEGGERAVITLDGKYLPPNPFDRVRYRGGLMDFAQRTIDIARQNVAEGGRPFATVIVKNGEILAESPNLVAQTHDPTAHAEILAIRKACTRIGTEHLIGATIYVLAQPCPMCLGSLYYCSPDEVVFLTTRDAYEPHYVDDRKYFELNMFYDEFAKPWDQRRLPMRYEPRDAAVDVYKLWQERNGGERRVPGAPTSTRPGKNPRGE

SEQ ID NO: 182 - protein, 157 aa, Artificial Sequence
  Description of artificial sequence: pYY-BEM4.73; tr|I3XF03|I3XF03_RHIFR polypeptide sequence
MKQRCMSPKSAQRFWDNDMHNNKDRPMSENELFVAAREAMAKAHAPYSKFPVGAAIRAEDGQIYTGANIENLSFPEGWCAETTAISHMVMAGQRKIMEVAVIAEKLALCPPCGGCRQRLAEFSGASTRIYLCDETGIKKSLALSDLLPHSFETEILG

SEQ ID NO: 183 - protein, 595 aa, Artificial Sequence
  Description of artificial sequence: pYY-BEM4.74; tr|F8IEF3|F8IEF3_ALIAT polypeptide sequence
MDAKELETRGWLCMRAVDVIDKKRRGEALAEEELRFLIEGYVAGRIPDYQMSAFLMAVVWRGMTREETLVLTRLLADSGERLDLSGIPGVKVDKHSTGGVGDKATLVVLPLVASIGVPVIKMSGRGLGHTGGTIDKLESIPGFRTDLSVAELVAQVRQVGIALGGQTADLAPADKKLYALRDVTGTVESLPLIASSVMSKKLAGGADAIVLDVKVGDGAFMKSRSDARRLARLMVEIGEAAGRRTVAVLSNMDQPLGCAIGNALEVAEAIRVLSGEGPFDLAEIALALAEEMTVLAGVAATREEARRMLRQSVAEGRALETLRRWIAAQGGDPAVVDDPSRLPQAPVQMPYLPKKAGFVAKLSALAFGLAAMRLGAGRETKEEAIDPSVGIVLHAKVGDRVQTHRPMFTVHARTGEDALRCIQELEAAIQISDDPVEAPPLILARIDRSEALPYADLMDAAREARDRAYVPYSGFAVGAALELADGRMVTGANVENASYGLTNCAERSAVFRAVAEGGPGTKPEIRAVAVIADSPEPVSPCGACRQVLAEFCSPDTPVYLGNLQGDVRETTVGALLPGAFTDAQMANVRRQDKEA

SEQ ID NO: 184 - protein, 153 aa, Artificial Sequence
  Description of artificial sequence: pYY-BEM4.75; tr|A0A1G3M638|A0A1G3M638_9SPIR polypeptide sequence
MKTTNINALDKWDLRFLQMAEHVAEWSKDPSTKVGAVIVRPDRTIASVGFNGFARGVRDTVERLWNRELKYPLTVHAELNAILSAHEPVRGHSLYVSPLSPCSNCAGVIIQSGIARVVAKCGQVNNPAQWSESFNLALTAFAEAGVSVILVEH

SEQ ID NO: 185 - protein, 177 aa, Artificial Sequence
  Description of artificial sequence: pYY-BEM4.76; tr|A0A3D9LFR2|A0A3D9LFR2_9MICC polypeptide sequence
MEQNDHGSSGAFSDPFEDDIPLTASLPRITGTGSGIDWQRLESTARAAMTRAYVPYSRFPVGAAALVEDGRVVAGCNIENASLGLTLCAECSLVSNLQMSGGGRIVAFYCVDGNGEVLMPCGRCRQLLYEFHAPGMRLMGPDGELTMDEVLPLAFGPADMTHLSDSAASTDDPGRTR

SEQ ID NO: 186 - protein, 172 aa, Artificial Sequence
  Description of artificial sequence: pYY-BEM4.77; tr|A0A3B9YGB5|A0A3B9YGB5_9BACT polypeptide sequence
MAKPISKKYRKLIETAKAARKKAYSPYSRYQVGAAVLTESGRIYSGANMENASYGLCMCAERVAIANAVTRGEKVLQAVCVVGKKARPCGACRQVMLEFSTKETELLMVDIDPNARRDTVIRTRVYSMLPNPFDPFESGMLPQHPQNLLRRRKSPQPRRKRRSRPVHREVSR

SEQ ID NO: 187 - protein, 391 aa, Artificial Sequence
  Description of artificial sequence: pYY-BEM4.78; tr|A0A182F569|A0A182F569_ANOAL polypeptide sequence
MPRPSQFRVSSSQSLSNSQIQASQSSDSVVDITSYVNAVVKALLNLSCTKTIIKRADLVNIALKGNGRLIGRVLQDANIELKEIYGYELIEVEKSKTMILCSTLAAGSMDELNDANRRRYTFLYLILGYIFMKNGSVPETIVWEFLETLGIEEQQEHNYFGDVRKLYDSLFKQAYLTRTKQALEGLNDDVMLISWGVRSKHEVSKKDILAGFCKVMNRDPVDFKAQYIEANEKDDKMNNNINGTVDGRNTVEYSSLDASVKELIEAAIKVRNNAYCPYSNFAVGAALRTVGGDIVTGCNVENGTFGPSVCAERTAVCKAVSEGHREFTAVAVVAFQETEFTAPCGTCRQTLSEFSRKDIPIYLVKPSPVRVMVTSLFQLLPHAFSPSFLNK

SEQ ID NO: 188 - protein, 151 aa, Artificial Sequence
  Description of artificial sequence: pYY-BEM4.79; tr|A0A264Z0D4|A0A264Z0D4_9BACI polypeptide sequence
MEPKKLIEEAIVASKQAYVQYSNFHVGAALLTKDGKLYHGCNIENASYGLTNCAERTAIFKAVSEGEKEFQAIAVVGDTEGPISPCGACRQVLAEFFSPDTVVILANLKGDHVVTNINELLPGFFSSKDLQKKVKNCFEKNALGSSCLRPI

SEQ ID NO: 189 - protein, 229 aa, Artificial Sequence
  Description of artificial sequence: pYY-BEM4.80; tr|A0A1L9Q1R3|A0A1L9Q1R3_ASPVE polypeptide sequence
MPLSAEEAALVETATATINSIPLSEDYSVASAAKASDGRVFTGVNVYHFTGGPCAELVVLGVAAAAGAAQLTHIVAVANEQRGILSPCGRCRQVLLDLQPNIQVIVGKEGSEQSVPVAQLLPFSYRQPDQHTPVIFKALTSSGPVVVDFFATWCGPCKAVAPVVGKLSETYTDVRFIQVDVDKARSISQEHDIRAMPTFVLYKDGKLLDKRVVGGNMKELEEQIKAIIA

SEQ ID NO: 190 - protein, 18 aa, Artificial Sequence
  Description of artificial sequence: synthetic peptide
KRTADGSEFESPKKKRKV

SEQ ID NO: 191 - protein, 16 aa, Artificial Sequence
  Description of artificial sequence: synthetic peptide
KRPAATKKAGQAKKKK

SEQ ID NO: 192 - protein, 17 aa, Artificial Sequence
  Description of artificial sequence: synthetic peptide
KKTELQTTNAENKTKKL

SEQ ID NO: 193 - protein, 19 aa, Artificial Sequence
  Description of artificial sequence: synthetic peptide
KRGINDRNFWRGENGRKTR

SEQ ID NO: 194 - protein, 16 aa, Artificial Sequence
  Description of artificial sequence: synthetic peptide
RKSGKIAAIVVKRPRK

SEQ ID NO: 195 - protein, 7 aa, Artificial Sequence
  Description of artificial sequence: synthetic peptide
PKKKRKV

SEQ ID NO: 196 - protein, 30 aa, Artificial Sequence
  Description of artificial sequence: synthetic polypeptide
MDSLLMNRRKFLYQFKNVRWAKGRRETYLC

SEQ ID NO: 197 - protein, 1368 aa, Streptococcus pyogenes [sequence omitted]

SEQ ID NO: 198 - DNA, 4104 bp, Streptococcus pyogenes
  misc_feature (1)..(4104): wild type spCas9 polynucleotide sequence
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 199 - protein, 1367 aa, Streptococcus pyogenes
  MISC_FEATURE (1)..(1367): spCas9 polypeptide sequence
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 200 - DNA, 4212 bp, Artificial Sequence
  Description of artificial sequence: wild-type Cas9 polynucleotide sequence
  misc_feature (5)..(58): RuvC domain
  misc_feature (718)..(764): RuvC domain
  misc_feature (772)..(901): HNH domain
  misc_feature (906)..(1101): RuvC domain
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 201 - protein, 1368 aa, Artificial Sequence
  Description of artificial sequence: exemplary catalytically active Cas9 nickase (nCas9) polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 202 - DNA, 4107 bp, Streptococcus pyogenes
  misc_feature (1)..(4107): Cas9 from Streptococcus pyogenes (NCBI Ref. Seq.: NC_002737.2) polynucleotide sequence
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 203 - protein, 1368 aa, Artificial Sequence
  Description of sequence: catalytically inactive Cas9 (dCas9) polypeptide sequence
  MISC_FEATURE (5)..(58): RuvC domain
  MISC_FEATURE (718)..(764): RuvC domain
  MISC_FEATURE (773)..(902): HNH domain
  MISC_FEATURE (907)..(1102): RuvC domain
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 204 - protein, 345 aa, Sulfolobus islandicus
  MISC_FEATURE (1)..(345): tr|F0NN87|F0NN87_SULIHCRISPR-associatedCasx protein OS = Sulfolobus islandicus (strain HVE10/4) GN = SiH_0402 PE=4 SV=1); CasX polypeptide sequence
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 205 - protein, 345 aa, Sulfolobus islandicus
  MISC_FEATURE (1)..(345): tr|F0NH53|F0NH53_SULIR CRISPR associated protein, Casx OS = Sulfolobus islandicus (strain REY15A) GN=SiRe_0771 PE=4 SV=1); CasX polypeptide sequence
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 206 - protein, 987 aa, Deltaproteobacteria
  MISC_FEATURE (1)..(987): CasX polypeptide sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 207 - protein, 1210 aa, Parcubacteria group bacterium
  MISC_FEATURE (1)..(1210): APG80656.1 CRISPR-associated protein CasY [uncultured Parcubacteria group bacterium]; CasY polypeptide sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 208 - protein, 1082 aa, Neisseria meningitidis
  MISC_FEATURE (1)..(1082): NCBI Reference:  WP_002235162.1; type II CRISPR RNA-guided endonuclease Cas9; Nme1Cas9 polypeptide sequence
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 209 - protein, 1082 aa, Neisseria meningitidis
  MISC_FEATURE (1)..(1082): NCBI Reference:  WP_002230835; type II CRISPR RNA-guided endonuclease Cas9; Nme2Cas9 polypeptide sequence
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 210 - protein, 1300 aa, Francisella novicida
  MISC_FEATURE (1)..(1300): wild type Cpf1 polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 211 - protein, 1300 aa, Francisella novicida
  MISC_FEATURE (1)..(1300): Cpf1 D917A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 212 - protein, 1300 aa, Francisella novicida
  MISC_FEATURE (1)..(1300): Cpf1 E1006A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 213 - protein, 1300 aa, Francisella novicida
  MISC_FEATURE (1)..(1300): Cpf1 D1255A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 214 - protein, 1300 aa, Francisella novicida
  MISC_FEATURE (1)..(1300): Cpf1 D917A/E1006A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 215 - protein, 1300 aa, Francisella novicida
  MISC_FEATURE (1)..(1300): Cpf1 D917A/D1255A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 216 - protein, 1300 aa, Francisella novicida
  MISC_FEATURE (1)..(1300): Cpf1 E1006A/D1255A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 217 - protein, 1300 aa, Francisella novicida
  MISC_FEATURE (1)..(1300): Cpf1 D917A/E1006A/D1255A polypeptide sequence
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 218 - protein, 1052 aa, Staphylococcus aureus
  MISC_FEATURE (1)..(1052): Exemplary SaCas9 polypeptide sequence
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 219 - protein, 1052 aa, Staphylococcus aureus
  MISC_FEATURE (1)..(1052): SaCas9n polypeptide sequence
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 220 - protein, 1052 aa, Staphylococcus aureus
  MISC_FEATURE (1)..(1052): SaKKH Cas9 polypeptide sequence
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 221 - protein, 707 aa, Artificial Sequence
  Description of artificial sequence: Casphi-1 polypeptide sequence
MADTPTLFTQFLRHHLPGQRFRKDILKQAGRILANKGEDATIAFLRGKSEESPPDFQPPVKCPIIACSRPLTEWPIYQASVAIQGYVYGQSLAEFEASDPGCSKDGLLGWFDKTGVCTDYFSVQGLNLIFQNARKRYIGVQTKVTNRNEKRHKKLKRINAKRIAEGLPELTSDEPESALDETGHLIDPPGLNTNIYCYQQVSPKPLALSEVNQLPTAYAGYSTSGDDPIQPMVTKDRLSISKGQPGYIPEHQRALLSQKKHRRMRGYGLKARALLVIVRIQDDWAVIDLRSLLRNAYWRRIVQTKEPSTITKLLKLVTGDPVLDATRMVATFTYKPGIVQVRSAKCLKNKQGSKLFSERYLNETVSVTSIDLGSNNLVAVATYRLVNGNTPELLQRFTLPSHLVKDFERYKQAHDTLEDSIQKTAVASLPQGQQTEIRMWSMYGFREAQERVCQELGLADGSIPWNVMTATSTILTDLFLARGGDPKKCMFTSEPKKKKNSKQVLYKIRDRAWAKMYRTLLSKETREAWNKALWGLKRGSPDYARLSKRKEELARRCVNYTISTAEKRAQCGRTIVALEDLNIGFFHGRGKQEPGWVGLFTRKKENRWLMQALHKAFLELAHHRGYHVIEVNPAYTSQTCPVCRHCDPDNRDQHNREAFHCIGCGFRGNADLDVATHNIAMVAITGESLKRARGSVASKTPQPLAAE

SEQ ID NO: 222 - protein, 757 aa, Artificial Sequence
  Description of artificial sequence: Casphi-2 polypeptide sequence
MPKPAVESEFSKVLKKHFPGERFRSSYMKRGGKILAAQGEEAVVAYLQGKSEEEPPNFQPPAKCHVVTKSRDFAEWPIMKASEAIQRYIYALSTTERAACKPGKSSESHAAWFAATGVSNHGYSHVQGLNLIFDHTLGRYDGVLKKVQLRNEKARARLESINASRADEGLPEIKAEEEEVATNETGHLLQPPGINPSFYVYQTISPQAYRPRDEIVLPPEYAGYVRDPNAPIPLGVVRNRCDIQKGCPGYIPEWQREAGTAISPKTGKAVTVPGLSPKKNKRMRRYWRSEKEKAQDALLVTVRIGTDWVVIDVRGLLRNARWRTIAPKDISLNALLDLFTGDPVIDVRRNIVTFTYTLDACGTYARKWTLKGKQTKATLDKLTATQTVALVAIDLGQTNPISAGISRVTQENGALQCEPLDRFTLPDDLLKDISAYRIAWDRNEEELRARSVEALPEAQQAEVRALDGVSKETARTQLCADFGLDPKRLPWDKMSSNTTFISEALLSNSVSRDQVFFTPAPKKGAKKKAPVEVMRKDRTWARAYKPRLSVEAQKLKNEALWALKRTSPEYLKLSRRKEELCRRSINYVIEKTRRRTQCQIVIPVIEDLNVRFFHGSGKRLPGWDNFFTAKKENRWFIQGLHKAFSDLRTHRSFYVFEVRPERTSITCPKCGHCEVGNRDGEAFQCLSCGKTCNADLDVATHNLTQVALTGKTMPKREEPRDAQGTAPARKTKKASKSKAPPAEREDQTPAQEPSQTS

SEQ ID NO: 223 - protein, 766 aa, Artificial Sequence
  Description of artificial sequence: Casphi-3 polypeptide sequence
MEKEITELTKIRREFPNKKFSSTDMKKAGKLLKAEGPDAVRDFLNSCQEIIGDFKPPVKTNIVSISRPFEEWPVSMVGRAIQEYYFSLTKEELESVHPGTSSEDHKSFFNITGLSNYNYTSVQGLNLIFKNAKAIYDGTLVKANNKNKKLEKKFNEINHKRSLEGLPIITPDFEEPFDENGHLNNPPGINRNIYGYQGCAAKVFVPSKHKMVSLPKEYEGYNRDPNLSLAGFRNRLEIPEGEPGHVPWFQRMDIPEGQIGHVNKIQRFNFVHGKNSGKVKFSDKTGRVKRYHHSKYKDATKPYKFLEESKKVSALDSILAIITIGDDWVVFDIRGLYRNVFYRELAQKGLTAVQLLDLFTGDPVIDPKKGVVTFSYKEGVVPVFSQKIVPRFKSRDTLEKLTSQGPVALLSVDLGQNEPVAARVCSLKNINDKITLDNSCRISFLDDYKKQIKDYRDSLDELEIKIRLEAINSLETNQQVEIRDLDVFSADRAKANTVDMFDIDPNLISWDSMSDARVSTQISDLYLKNGGDESRVYFEINNKRIKRSDYNISQLVRPKLSDSTRKNLNDSIWKLKRTSEEYLKLSKRKLELSRAVVNYTIRQSKLLSGINDIVIILEDLDVKKKFNGRGIRDIGWDNFFSSRKENRWFIPAFHKAFSELSSNRGLCVIEVNPAWTSATCPDCGFCSKENRDGINFTCRKCGVSYHADIDVATLNIARVAVLGKPMSGPADRERLGDTKKPRVARSRKTMKRKDISNSTVEAMVTA

SEQ ID NO: 224 - protein, 765 aa, Artificial Sequence
  Description of artificial sequence: Casphi-4 polypeptide sequence
MYSLEMADLKSEPSLLAKLLRDRFPGKYWLPKYWKLAEKKRLTGGEEAACEYMADKQLDSPPPNFRPPARCVILAKSRPFEDWPVHRVASKAQSFVIGLSEQGFAALRAAPPSTADARRDWLRSHGASEDDLMALEAQLLETIMGNAISLHGGVLKKIDNANVKAAKRLSGRNEARLNKGLQELPPEQEGSAYGADGLLVNPPGLNLNIYCRKSCCPKPVKNTARFVGHYPGYLRDSDSILISGTMDRLTIIEGMPGHIPAWQREQGLVKPGGRRRRLSGSESNMRQKVDPSTGPRRSTRSGTVNRSNQRTGRNGDPLLVEIRMKEDWVLLDARGLLRNLRWRESKRGLSCDHEDLSLSGLLALFSGDPVIDPVRNEVVFLYGEGIIPVRSTKPVGTRQSKKLLERQASMGPLTLISCDLGQTNLIAGRASAISLTHGSLGVRSSVRIELDPEIIKSFERLRKDADRLETEILTAAKETLSDEQRGEVNSHEKDSPQTAKASLCRELGLHPPSLPWGQMGPSTTFIADMLISHGRDDDAFLSHGEFPTLEKRKKFDKRFCLESRPLLSSETRKALNESLWEVKRTSSEYARLSQRKKEMARRAVNFVVEISRRKTGLSNVIVNIEDLNVRIFHGGGKQAPGWDGFFRPKSENRWFIQAIHKAFSDLAAHHGIPVIESDPQRTSMTCPECGHCDSKNRNGVRFLCKGCGASMDADFDAACRNLERVALTGKPMPKPSTSCERLLSATTGKVCSDHSLSHDAIEKAS

SEQ ID NO: 225 - protein, 793 aa, Artificial Sequence
  Description of artificial sequence: Casphi-5 polypeptide sequence
MSSLPTPLELLKQKHADLFKGLQFSSKDNKMAGKVLKKDGEEAALAFLSERGVSRGELPNFRPPAKTLVVAQSRPFEEFPIYRVSEAIQLYVYSLSVKELETVPSGSSTKKEHQRFFQDSSVPDFGYTSVQGLNKIFGLARGIYLGVITRGENQLQKAKSKHEALNKKRRASGEAETEFDPTPYEYMTPERKLAKPPGVNHSIMCYVDISVDEFDFRNPDGIVLPSEYAGYCREINTAIEKGTVDRLGHLKGGPGYIPGHQRKESTTEGPKINFRKGRIRRSYTALYAKRDSRRVRQGKLALPSYRHHMMRLNSNAESAILAVIFFGKDWVVFDLRGLLRNVRWRNLFVDGSTPSTLLGMFGDPVIDPKRGVVAFCYKEQIVPVVSKSITKMVKAPELLNKLYLKSEDPLVLVAIDLGQTNPVGVGVYRVMNASLDYEVVTRFALESELLREIESYRQRTNAFEAQIRAETFDAMTSEEQEEITRVRAFSASKAKENVCHRFGMPVDAVDWATMGSNTIHIAKWVMRHGDPSLVEVLEYRKDNEIKLDKNGVPKKVKLTDKRIANLTSIRLRFSQETSKHYNDTMWELRRKHPVYQKLSKSKADFSRRVVNSIIRRVNHLVPRARIVFIIEDLKNLGKVFHGSGKRELGWDSYFEPKSENRWFIQVLHKAFSETGKHKGYYIIECWPNWTSCTCPKCSCCDSENRHGEVFRCLACGYTCNTDFGTAPDNLVKIATTGKGLPGPKKRCKGSSKGKNPKIARSSETGVSVTESGAPKVKKSSPTQTSQSSSQSAP

SEQ ID NO: 226 - protein, 441 aa, Artificial Sequence
  Description of artificial sequence: Casphi-6 polypeptide sequence
MNKIEKEKTPLAKLMNENFAGLRFPFAIIKQAGKKLLKEGELKTIEYMTGKGSIEPLPNFKPPVKCLIVAKRRDLKYFPICKASCEIQSYVYSLNYKDFMDYFSTPMTSQKQHEEFFKKSGLNIEYQNVAGLNLIFNNVKNTYNGVILKVKNRNEKLKKKAIKNNYEFEEIKTFNDDGCLINKPGINNVIYCFQSISPKILKNITHLPKEYNDYDCSVDRNIIQKYVSRLDIPESQPGHVPEWQRKLPEFNNTNNPRRRRKWYSNGRNISKGYSVDQVNQAKIEDSLLAQIKIGEDWIILDIRGLLRDLNRRELISYKNKLTIKDVLGFFSDYPIIDIKKNLVTFCYKEGVIQVVSQKSIGNKKSKQLLEKLIENKPIALVSIDLGQTNPVSVKISKLNKINNKISIESFTYRFLNEEILKEIEKYRKDYDKLELKLINEA

SEQ ID NO: 227 - protein, 772 aa, Artificial Sequence
  Description of artificial sequence: Casphi-7 polypeptide sequence
MSNTAVSTREHMSNKTTPPSPLSLLLRAHFPGLKFESQDYKIAGKKLRDGGPEAVISYLTGKGQAKLKDVKPPAKAFVIAQSRPFIEWDLVRVSRQIQEKIFGIPATKGRPKQDGLSETAFNEAVASLEVDGKSKLNEETRAAFYEVLGLDAPSLHAQAQNALIKSAISIREGVLKKVENRNEKNLSKTKRRKEAGEEATFVEEKAHDERGYLIHPPGVNQTIPGYQAVVIKSCPSDFIGLPSGCLAKESAEALTDYLPHDRMTIPKGQPGYVPEWQHPLLNRRKNRRRRDWYSASLNKPKATCSKRSGTPNRKNSRTDQIQSGRFKGAIPVLMRFQDEWVIIDIRGLLRNARYRKLLKEKSTIPDLLSLFTGDPSIDMRQGVCTFIYKAGQACSAKMVKTKNAPEILSELTKSGPVVLVSIDLGQTNPIAAKVSRVTQLSDGQLSHETLLRELLSNDSSDGKEIARYRVASDRLRDKLANLAVERLSPEHKSEILRAKNDTPALCKARVCAALGLNPEMIAWDKMTPYTEFLATAYLEKGGDRKVATLKPKNRPEMLRRDIKFKGTEGVRIEVSPEAAEAYREAQWDLQRTSPEYLRLSTWKQELTKRILNQLRHKAAKSSQCEVVVMAFEDLNIKMMHGNGKWADGGWDAFFIKKRENRWFMQAFHKSLTELGAHKGVPTIEVTPHRTSITCTKCGHCDKANRDGERFACQKCGFVAHADLEIATDNIERVALTGKPMPKPESERSGDAKKSVGARKAAFKPEEDAEAAE

SEQ ID NO: 228 - protein, 717 aa, Artificial Sequence
  Description of artificial sequence: Casphi-8 polypeptide sequence
MIKPTVSQFLTPGFKLIRNHSRTAGLKLKNEGEEACKKFVRENEIPKDECPNFQGGPAIANIIAKSREFTEWEIYQSSLAIQEVIFTLPKDKLPEPILKEEWRAQWLSEHGLDTVPYKEAAGLNLIIKNAVNTYKGVQVKVDNKNKNNLAKINRKNEIAKLNGEQEISFEEIKAFDDKGYLLQKPSPNKSIYCYQSVSPKPFITSKYHNVNLPEEYIGYYRKSNEPIVSPYQFDRLRIPIGEPGYVPKWQYTFLSKKENKRRKLSKRIKNVSPILGIICIKKDWCVFDMRGLLRTNHWKKYHKPTDSINDLFDYFTGDPVIDTKANVVRFRYKMENGIVNYKPVREKKGKELLENICDQNGSCKLATVDVGQNNPVAIGLFELKKVNGELTKTLISRHPTPIDFCNKITAYRERYDKLESSIKLDAIKQLTSEQKIEVDNYNNNFTPQNTKQIVCSKLNINPNDLPWDKMISGTHFISEKAQVSNKSEIYFTSTDKGKTKDVMKSDYKWFQDYKPKLSKEVRDALSDIEWRLRRESLEFNKLSKSREQDARQLANWISSMCDVIGIENLVKKNNFFGGSGKREPGWDNFYKPKKENRWWINAIHKALTELSQNKGKRVILLPAMRTSITCPKCKYCDSKNRNGEKFNCLKCGIELNADIDVATENLATVAITAQSMPKPTCERSGDAKKPVRARKAKAPEFHDKLAPSYTVVLREAV

SEQ ID NO: 229 - protein, 793 aa, Artificial Sequence
  Description of artificial sequence: Casphi-9 polypeptide sequence
MRSSREIGDKILMRQPAEKTAFQVFRQEVIGTQKLSGGDAKTAGRLYKQGKMEAAREWLLKGARDDVPPNFQPPAKCLVVAVSHPFEEWDISKTNHDVQAYIYAQPLQAEGHLNGLSEKWEDTSADQHKLWFEKTGVPDRGLPVQAINKIAKAAVNRAFGVVRKVENRNEKRRSRDNRIAEHNRENGLTEVVREAPEVATNADGFLLHPPGIDPSILSYASVSPVPYNSSKHSFVRLPEEYQAYNVEPDAPIPQFVVEDRFAIPPGQPGYVPEWQRLKCSTNKHRRMRQWSNQDYKPKAGRRAKPLEFQAHLTRERAKGALLVVMRIKEDWVVFDVRGLLRNVEWRKVLSEEAREKLTLKGLLDLFTGDPVIDTKRGIVTFLYKAEITKILSKRTVKTKNARDLLLRLTEPGEDGLRREVGLVAVDLGQTHPIAAAIYRIGRTSAGALESTVLHRQGLREDQKEKLKEYRKRHTALDSRLRKEAFETLSVEQQKEIVTVSGSGAQITKDKVCNYLGVDPSTLPWEKMGSYTHFISDDFLRRGGDPNIVHFDRQPKKGKVSKKSQRIKRSDSQWVGRMRPRLSQETAKARMEADWAAQNENEEYKRLARSKQELARWCVNTLLQNTRCITQCDEIVVVIEDLNVKSLHGKGAREPGWDNFFTPKTENRWFIQILHKTFSELPKHRGEHVIEGCPLRTSITCPACSYCDKNSRNGEKFVCVACGATFHADFEVATYNLVRLATTGMPMPKSLERQGGGEKAGGARKARKKAKQVEKIVVQANANVTMNGASLHSP

SEQ ID NO: 230 - protein, 812 aa, Artificial Sequence
  Description of artificial sequence: Casphi-10 polypeptide sequence
MDMLDTETNYATETPAQQQDYSPKPPKKAQRAPKGFSKKARPEKKPPKPITLFTQKHFSGVRFLKRVIRDASKILKLSESRTITFLEQAIERDGSAPPDVTPPVHNTIMAVTRPFEEWPEVILSKALQKHCYALTKKIKIKTWPKKGPGKKCLAAWSARTKIPLIPGQVQATNGLFDRIGSIYDGVEKKVTNRNANKKLEYDEAIKEGRNPAVPEYETAYNIDGTLINKPGYNPNLYITQSRTPRLITEADRPLVEKILWQMVEKKTQSRNQARRARLEKAAHLQGLPVPKFVPEKVDRSQKIEIRIIDPLDKIEPYMPQDRMAIKASQDGHVPYWQRPFLSKRRNRRVRAGWGKQVSSIQAWLTGALLVIVRLGNEAFLADIRGALRNAQWRKLLKPDATYQSLFNLFTGDPVVNTRTNHLTMAYREGVVNIVKSRSFKGRQTREHLLTLLGQGKTVAGVSFDLGQKHAAGLLAAHFGLGEDGNPVFTPIQACFLPQRYLDSLTNYRNRYDALTLDMRRQSLLALTPAQQQEFADAQRDPGGQAKRACCLKLNLNPDEIRWDLVSGISTMISDLYIERGGDPRDVHQQVETKPKGKRKSEIRILKIRDGKWAYDFRPKIADETRKAQREQLWKLQKASSEFERLSRYKINIARAIANWALQWGRELSGCDIVIPVLEDLNVGSKFFDGKGKWLLGWDNRFTPKKENRWFIKVLHKAVAELAPHRGVPVYEVMPHRTSMTCPACHYCHPTNREGDRFECQSCHVVKNTDRDVAPYNILRVAVEGKTLDRWQAEKKPQAEPDRPMILIDNQES

SEQ ID NO: 231 - protein, 84 aa, Artificial Sequence
  Description of artificial sequence: synthetic polypeptide sequence
MTNLSDIIEKETGKQLVIQESILMLPEEVEEVIGNKPESDILVHTAYDESTDENVMLLTSDAPEYKPWALVIQDSNGENKIKML

SEQ ID NO: 232 - protein, 1129 aa, Alicyclobacillus acido-terrestris
  MISC_FEATURE (1)..(1129): Cas12b/C2c1; sp|T0D7A2|C2C1_ALIAG CRISPR-associated endonuclease C2c1 OS = Alicyclobacillus acido-terrestris (strain ATCC 49025 / DSM 3922/ CIP 106132 / NCIMB 13137/GD3B) GN=c2c1 PE=1 SV=1; Cas12b/C2c1 polypeptide sequence
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 233 - protein, 1368 aa, Mus musculus
  MISC_FEATURE (1)..(1368): high fidelity Cas9 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 234 - protein, 1368 aa, S. pyogenes
  MISC_FEATURE (1)..(1368): PAM-binding SpEQR Cas9 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESVLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 235 - protein, 1368 aa, S. pyogenes
  MISC_FEATURE (1)..(1368): PAM-binding SpVQR Cas9 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 236 - protein, 1368 aa, S. pyogenes
  MISC_FEATURE (1)..(1368): SpVQR Cas9 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 237 - protein, 1359 aa, Streptococcus macacae
  MISC_FEATURE (1)..(1359): SpyMacCas9 polypeptide sequence
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 238 - protein, 1410 aa, Artificial Sequence
  Description of artificial sequence: CP5 polypeptide sequence
  MISC_FEATURE (1)..(341): Sequence derived from Cas9
  MISC_FEATURE (342)..(362): Linker sequence
  MISC_FEATURE (363)..(1388): Sequence derived from Cas9
  MISC_FEATURE (1389)..(1410): Bipartite nuclear localization sequence
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 239 - protein, 1302 aa, Artificial Sequence
  Description of artificial sequence: Cas12c1 polypeptide sequence
MQTKKTHLHLISAKASRKYRRTIACLSDTAKKDLERRKQSGAADPAQELSCLKTIKFKLEVPEGSKLPSFDRISQIYNALETIEKGSLSYLLFALILSGFRIFPNSSAAKTFASSSCYKNDQFASQIKEIFGEMVKNFIPSELESILKKGRRKNNKDWTEENIKRVLNSEFGRKNSEGSSALFDSFLSKFSQELFRKFDSWNEVNKKYLEAAELLDSMLASYGPFDSVCKMIGDSDSRNSLPDKSTIAFTNNAEITVDIESSVMPYMAIAALLREYRQSKSKAAPVAYVQSHLTTTNGNGLSWFFKFGLDLIRKAPVSSKQSTSDGSKSLQELFSVPDDKLDGLKFIKEACEALPEASLLCGEKGELLGYQDFRTSFAGHIDSWVANYVNRLFELIELVNQLPESIKLPSILTQKNHNLVASLGLQEAEVSHSLELFEGLVKNVRQTLKKLAGIDISSSPNEQDIKEFYAFSDVLNRLGSIRNQIENAVQTAKKDKIDLESAIEWKEWKKLKKLPKLNGLGGGVPKQQELLDKALESVKQIRHYQRIDFERVIQWAVNEHCLETVPKFLVDAEKKKINKESSTDFAAKENAVRFLLEGIGAAARGKTDSVSKAAYNWFVVNNFLAKKDLNRYFINCQGCIYKPPYSKRRSLAFALRSDNKDTIEVVWEKFETFYKEISKEIEKFNIFSQEFQTFLHLENLRMKLLLRRIQKPIPAEIAFFSLPQEYYDSLPPNVAFLALNQEITPSEYITQFNLYSSFLNGNLILLRRSRSYLRAKFSWVGNSKLIYAAKEARLWKIPNAYWKSDEWKMILDSNVLVFDKAGNVLPAPTLKKVCEREGDLRLFYPLLRQLPHDWCYRNPFVKSVGREKNVIEVNKEGEPKVASALPGSLFRLIGPAPFKSLLDDCFFNPLDKDLRECMLIVDQEISQKVEAQKVEASLESCTYSIAVPIRYHLEEPKVSNQFENVLAIDQGEAGLAYAVFSLKSIGEAETKPIAVGTIRIPSIRRLIHSVSTYRKKKQRLQNFKQNYDSTAFIMRENVTGDVCAKIVGLMKEFNAFPVLEYDVKNLESGSRQLSAVYKAVNSHFLYFKEPGRDALRKQLWYGGDSWTIDGIEIVTRERKEDGKEGVEKIVPLKVFPGRSVSARFTSKTCSCCGRNVFDWLFTEKKAKTNKKFNVNSKGELTTADGVIQLFEADRSKGPKFYARRKERTPLTKPIAKGSYSLEEIERRVRTNLRRAPKSKQSRDTSQSQYFCVYKDCALHFSGMQADENAAINIGRRFLTALRKNRRSDFPSNVKISDRLLDN

SEQ ID NO: 240 - protein, 1218 aa, Artificial Sequence
  Description of artificial sequence: Cas12c2 polypeptide sequence
MTKHSIPLHAFRNSGADARKWKGRIALLAKRGKETMRTLQFPLEMSEPEAAAINTTPFAVAYNAIEGTGKGTLFDYWAKLHLAGFRFFPSGGAATIFRQQAVFEDASWNAAFCQQSGKDWPWLVPSKLYERFTKAPREVAKKDGSKKSIEFTQENVANESHVSLVGASITDKTPEDQKEFFLKMAGALAEKFDSWKSANEDRIVAMKVIDEFLKSEGLHLPSLENIAVKCSVETKPDNATVAWHDAPMSGVQNLAIGVFATCASRIDNIYDLNGGKLSKLIQESATTPNVTALSWLFGKGLEYFRTTDIDTIMQDFNIPASAKESIKPLVESAQAIPTMTVLGKKNYAPFRPNFGGKIDSWIANYASRLMLLNDILEQIEPGFELPQALLDNETLMSGIDMTGDELKELIEAVYAWVDAAKQGLATLLGRGGNVDDAVQTFEQFSAMMDTLNGTLNTISARYVRAVEMAGKDEARLEKLIECKFDIPKWCKSVPKLVGISGGLPKVEEEIKVMNAAFKDVRARMFVRFEEIAAYVASKGAGMDVYDALEKRELEQIKKLKSAVPERAHIQAYRAVLHRIGRAVQNCSEKTKQLFSSKVIEMGVFKNPSHLNNFIFNQKGAIYRSPFDRSRHAPYQLHADKLLKNDWLELLAEISATLMASESTEQMEDALRLERTRLQLQLSGLPDWEYPASLAKPDIEVEIQTALKMQLAKDTVTSDVLQRAFNLYSSVLSGLTFKLLRRSFSLKMRFSVADTTQLIYVPKVCDWAIPKQYLQAEGEIGIAARVVTESSPAKMVTEVEMKEPKALGHFMQQAPHDWYFDASLGGTQVAGRIVEKGKEVGKERKLVGYRMRGNSAYKTVLDKSLVGNTELSQCSMIIEIPYTQTVDADFRAQVQAGLPKVSINLPVKETITASNKDEQMLFDRFVAIDLGERGLGYAVFDAKTLELQESGHRPIKAITNLLNRTHHYEQRPNQRQKFQAKFNVNLSELRENTVGDVCHQINRICAYYNAFPVLEYMVPDRLDKQLKSVYESVTNRYIWSSTDAHKSARVQFWLGGETWEHPYLKSAKDKKPLVLSPGRGASGKGTSQTCSCCGRNPFDLIKDMKPRAKIAVVDGKAKLENSELKLFERNLESKDDMLARRHRNERAGMEQPLTPGNYTVDEIKALLRANLRRAPKNRRTKDTTVSEYHCVFSDCGKTMHADENAAVNIGGKFIADIEK

SEQ ID NO: 241 - protein, 1252 aa, Oleiphilus sp. HI0009
  MISC_FEATURE (1)..(1252): OspCas12c polypeptide sequence
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 242 - protein, 767 aa, Artificial Sequence
  Description of artificial sequence: Cas12g1 polypeptide sequence
MAQASSTPAVSPRPRPRYREERTLVRKLLPRPGQSKQEFRENVKKLRKAFLQFNADVSGVCQWAIQFRPRYGKPAEPTETFWKFFLEPETSLPPNDSRSPEFRRLQAFEAAAGINGAAALDDPAFTNELRDSILAVASRPKTKEAQRLFSRLKDYQPAHRMILAKVAAEWIESRYRRAHQNWERNYEEWKKEKQEWEQNHPELTPEIREAFNQIFQQLEVKEKRVRICPAARLLQNKDNCQYAGKNKHSVLCNQFNEFKKNHLQGKAIKFFYKDAEKYLRCGLQSLKPNVQGPFREDWNKYLRYMNLKEETLRGKNGGRLPHCKNLGQECEFNPHTALCKQYQQQLSSRPDLVQHDELYRKWRREYWREPRKPVFRYPSVKRHSIAKIFGENYFQADFKNSVVGLRLDSMPAGQYLEFAFAPWPRNYRPQPGETEISSVHLHFVGTRPRIGFRFRVPHKRSRFDCTQEELDELRSRTFPRKAQDQKFLEAARKRLLETFPGNAEQELRLLAVDLGTDSARAAFFIGKTFQQAFPLKIVKIEKLYEQWPNQKQAGDRRDASSKQPRPGLSRDHVGRHLQKMRAQASEIAQKRQELTGTPAPETTTDQAAKKATLQPFDLRGLTVHTARMIRDWARLNARQIIQLAEENQVDLIVLESLRGFRPPGYENLDQEKKRRVAFFAHGRIRRKVTEKAVERGMRVVTVPYLASSKVCAECRKKQKDNKQWEKNKKRGLFKCEGCGSQAQVDENAARVLGRVFWGEIELPTAIP

SEQ ID NO: 243 - protein, 870 aa, Artificial Sequence
  Description of artificial sequence: Cas12h1 polypeptide sequence
MKVHEIPRSQLLKIKQYEGSFVEWYRDLQEDRKKFASLLFRWAAFGYAAREDDGATYISPSQALLERRLLLGDAEDVAIKFLDVLFKGGAPSSSCYSLFYEDFALRDKAKYSGAKREFIEGLATMPLDKIIERIRQDEQLSKIPAEEWLILGAEYSPEEIWEQVAPRIVNVDRSLGKQLRERLGIKCRRPHDAGYCKILMEVVARQLRSHNETYHEYLNQTHEMKTKVANNLTNEFDLVCEFAEVLEEKNYGLGWYVLWQGVKQALKEQKKPTKIQIAVDQLRQPKFAGLLTAKWRALKGAYDTWKLKKRLEKRKAFPYMPNWDNDYQIPVGLTGLGVFTLEVKRTEVVVDLKEHGKLFCSHSHYFGDLTAEKHPSRYHLKFRHKLKLRKRDSRVEPTIGPWIEAALREITIQKKPNGVFYLGLPYALSHGIDNFQIAKRFFSAAKPDKEVINGLPSEMVVGAADLNLSNIVAPVKARIGKGLEGPLHALDYGYGELIDGPKILTPDGPRCGELISLKRDIVEIKSAIKEFKACQREGLTMSEETTTWLSEVESPSDSPRCMIQSRIADTSRRLNSFKYQMNKEGYQDLAEALRLLDAMDSYNSLLESYQRMHLSPGEQSPKEAKFDTKRASFRDLLRRRVAHTIVEYFDDCDIVFFEDLDGPSDSDSRNNALVKLLSPRTLLLYIRQALEKRGIGMVEVAKDGTSQNNPISGHVGWRNKQNKSEIYFYEDKELLVMDADEVGAMNILCRGLNHSVCPYSFVTKAPEKKNDEKKEGDYGKRVKRFLKDRYGSSNVRFLVASMGFVTVTTKRPKDALVGKRLYYHGGELVTHDLHNRMKDEIKYLVEKEVLARRVSLSDSTIKSYKSFAHV

SEQ ID NO: 244 - protein, 1093 aa, Artificial Sequence
  Description of artificial sequence: Cas12i1 polypeptide sequence
MSNKEKNASETRKAYTTKMIPRSHDRMKLLGNFMDYLMDGTPIFFELWNQFGGGIDRDIISGTANKDKISDDLLLAVNWFKVMPINSKPQGVSPSNLANLFQQYSGSEPDIQAQEYFASNFDTEKHQWKDMRVEYERLLAELQLSRSDMHHDLKLMYKEKCIGLSLSTAHYITSVMFGTGAKNNRQTKHQFYSKVIQLLEESTQINSVEQLASIILKAGDCDSYRKLRIRCSRKGATPSILKIVQDYELGTNHDDEVNVPSLIANLKEKLGRFEYECEWKCMEKIKAFLASKVGPYYLGSYSAMLENALSPIKGMTTKNCKFVLKQIDAKNDIKYENEPFGKIVEGFFDSPYFESDTNVKWVLHPHHIGESNIKTLWEDLNAIHSKYEEDIASLSEDKKEKRIKVYQGDVCQTINTYCEEVGKEAKTPLVQLLRYLYSRKDDIAVDKIIDGITFLSKKHKVEKQKINPVIQKYPSFNFGNNSKLLGKIISPKDKLKHNLKCNRNQVDNYIWIEIKVLNTKTMRWEKHHYALSSTRFLEEVYYPATSENPPDALAARFRTKTNGYEGKPALSAEQIEQIRSAPVGLRKVKKRQMRLEAARQQNLLPRYTWGKDFNINICKRGNNFEVTLATKVKKKKEKNYKVVLGYDANIVRKNTYAAIEAHANGDGVIDYNDLPVKPIESGFVTVESQVRDKSYDQLSYNGVKLLYCKPHVESRRSFLEKYRNGTMKDNRGNNIQIDFMKDFEAIADDETSLYYFNMKYCKLLQSSIRNHSSQAKEYREEIFELLRDGKLSVLKLSSLSNLSFVMFKVAKSLIGTYFGHLLKKPKNSKSDVKAPPITDEDKQKADPEMFALRLALEEKRLNKVKSKKEVIANKIVAKALELRDKYGPVLIKGENISDTTKKGKKSSTNSFLMDWLARGVANKVKEMVMMHQGLEFVEVNPNFTSHQDPFVHKNPENTFRARYSRCTPSELTEKNRKEILSFLSDKPSKRPTNAYYNEGAMAFLATYGLKKNDVLGVSLEKFKQIMANILHQRSEDQLLFPSRGGMFYLATYKLDADATSVNWNGKQFWVCNADLVAAYNVGLVDIQKDFKKK

SEQ ID NO: 245 - protein, 1054 aa, Artificial Sequence
  Description of artificial sequence: Cas12i2 polypeptide sequence
MSSAIKSYKSVLRPNERKNQLLKSTIQCLEDGSAFFFKMLQGLFGGITPEIVRFSTEQEKQQQDIALWCAVNWFRPVSQDSLTHTIASDNLVEKFEEYYGGTASDAIKQYFSASIGESYYWNDCRQQYYDLCRELGVEVSDLTHDLEILCREKCLAVATESNQNNSIISVLFGTGEKEDRSVKLRITKKILEAISNLKEIPKNVAPIQEIILNVAKATKETFRQVYAGNLGAPSTLEKFIAKDGQKEFDLKKLQTDLKKVIRGKSKERDWCCQEELRSYVEQNTIQYDLWAWGEMFNKAHTALKIKSTRNYNFAKQRLEQFKEIQSLNNLLVVKKLNDFFDSEFFSGEETYTICVHHLGGKDLSKLYKAWEDDPADPENAIVVLCDDLKNNFKKEPIRNILRYIFTIRQECSAQDILAAAKYNQQLDRYKSQKANPSVLGNQGFTWTNAVILPEKAQRNDRPNSLDLRIWLYLKLRHPDGRWKKHHIPFYDTRFFQEIYAAGNSPVDTCQFRTPRFGYHLPKLTDQTAIRVNKKHVKAAKTEARIRLAIQQGTLPVSNLKITEISATINSKGQVRIPVKFDVGRQKGTLQIGDRFCGYDQNQTASHAYSLWEVVKEGQYHKELGCFVRFISSGDIVSITENRGNQFDQLSYEGLAYPQYADWRKKASKFVSLWQITKKNKKKEIVTVEAKEKFDAICKYQPRLYKFNKEYAYLLRDIVRGKSLVELQQIRQEIFRFIEQDCGVTRLGSLSLSTLETVKAVKGIIYSYFSTALNASKNNPISDEQRKEFDPELFALLEKLELIRTRKKKQKVERIANSLIQTCLENNIKFIRGEGDLSTTNNATKKKANSRSMDWLARGVFNKIRQLAPMHNITLFGCGSLYTSHQDPLVHRNPDKAMKCRWAAIPVKDIGDWVLRKLSQNLRAKNIGTGEYYHQGVKEFLSHYELQDLEEELLKWRSDRKSNIPCWVLQNRLAEKLGNKEAVVYIPVRGGRIYFATHKVATGAVSIVFDQKQVWVCNADHVAAANIALTVKGIGEQSSDEENPDGSRIKLQLTS

SEQ ID NO: 246 - protein, 4 aa, Artificial Sequence
  Description of artificial sequence: synthetic peptide sequence
GGGS

SEQ ID NO: 247 - protein, 5 aa, Artificial Sequence
  Description of artificial sequence: synthetic peptide sequence
GGGGS

SEQ ID NO: 248 - protein, 5 aa, Artificial Sequence
  Description of artificial sequence: synthetic peptide sequence
EAAAK

SEQ ID NO: 249 - protein, 16 aa, Artificial Sequence
  Description of artificial sequence: synthetic peptide sequence
SGSETPGTSESATPES

SEQ ID NO: 250 - protein, 6 aa, Artificial Sequence
  Description of artificial sequence: linker peptide sequence
GGSGGS

SEQ ID NO: 251 - protein, 20 aa, Artificial Sequence
  Description of artificial sequence: synthetic peptide sequence
GSSGSETPGTSESATPESSG

SEQ ID NO: 252 - DNA, 18 bp, Artificial Sequence
  Description of artificial sequence: synthetic oligonucleotide sequence
ggaggctctggaggaagc

SEQ ID NO: 253 - DNA, 60 bp, Artificial Sequence
  Description of artificial sequence: synthetic oligonucleotide sequence
ggctcttctggatctgaaacacctggcacaagcgagagcgccacccctgagagctctggc

SEQ ID NO: 254 - protein, 1129 aa, Alicyclobacillus acidiphilus
  MISC_FEATURE (1)..(1129): AacCas12b polypeptide sequence
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 255 - protein, 1140 aa, Bacillus hisashii
  MISC_FEATURE (1)..(1140): BhCas12b polypeptide sequence
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 256 - protein, 1108 aa, Bacillus thermoamylovorans
  MISC_FEATURE (1)..(1108): BTCas12b.BTCas12b polypeptide sequence
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 257 - protein, 1112 aa, Bacillus sp. V3-13
  MISC_FEATURE (1)..(1112): BvCas12b (Bacillus sp. V3-13) polypeptide sequence
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 258 - DNA, 47 bp, Artificial Sequence
  Description of artificial sequence: 5'UTR oligonucleotide sequence
gggaaataagagagaaaagaagagtaagaagaaatataagagccacc

SEQ ID NO: 259 - DNA, 101 bp, Artificial Sequence
  Description of artificial sequence: 3'UTR (TriLink standard UTR) polynucleotide sequence
gctggagcctcggtggccatgcttcttgccccttgggcctccccccagcccctcctccccttcctgcacccgtacccccgtggtctttgaataaagtctga

SEQ ID NO: 260 - DNA, 3420 bp, Bacillus hisashii
  misc_feature (1)..(3420): bhCas12b (V4) polynucleotide sequence
atggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaag

SEQ ID NO: 261 - protein, 17 aa, Artificial Sequence
  Description of artificial sequence: synthetic peptide sequence
MAPKKKRKVGIHGVPAA

SEQ ID NO: 262 - DNA, 51 bp, Artificial Sequence
  Description of artificial sequence: synthetic oligonucleotide sequence
atggccccaaagaagaagcggaaggtcggtatccacggagtcccagcagcc

SEQ ID NO: 263 - protein, 1554 aa, Artificial Sequence
  Description of artificial sequence: 101 Cas9 TadAins 1015 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 264 - protein, 1554 aa, Artificial Sequence
  Description of artificial sequence: 102 Cas9 TadAins 1022 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 265 - protein, 1554 aa, Artificial Sequence
  Description of artificial sequence: 103 Cas9 TadAins 1029 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 266 - protein, 1554 aa, Artificial Sequence
  Description of artificial sequence: 103 Cas9 TadAins 1040 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 267 - protein, 1554 aa, Artificial Sequence
  Description of artificial sequence: 105 Cas9 TadAins 1068 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDTGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 268 - protein, 1554 aa, Artificial Sequence
  Description of artificial sequence: 106 Cas9 TadAins 1247 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 269 - protein, 1554 aa, Artificial Sequence
  Description of artificial sequence: 107 Cas9 TadAins 1054 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 270 - protein, 1554 aa, Artificial Sequence
  Description of artificial sequence: 108 Cas9 TadAins 1026 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 271 - protein, 1540 aa, Artificial Sequence
  Description of artificial sequence: 109 Cas9 TadAins 768 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 272 - protein, 1540 aa, Artificial Sequence
  Description of artificial sequence: 110.1 Cas9 TadAins 1250 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 273 - protein, 1543 aa, Artificial Sequence
  Description of artificial sequence: 110.2 Cas9 TadAins 1250 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 274 - protein, 1546 aa, Artificial Sequence
  Description of artificial sequence: 110.3 Cas9 TadAins 1250 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 275 - protein, 1546 aa, Artificial Sequence
  Description of artificial sequence: 110.4 Cas9 TadAins 1250 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 276 - protein, 1546 aa, Artificial Sequence
  Description of artificial sequence: 110.5 Cas9 TadAins 1249 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 277 - protein, 1551 aa, Artificial Sequence
  Description of artificial sequence: 110.5 Cas9 TadAins delta 59-66 1250 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 278 - protein, 1546 aa, Artificial Sequence
  Description of artificial sequence: 110.6 Cas9 TadAins 1251 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 279 - protein, 1546 aa, Artificial Sequence
  Description of artificial sequence: 110.7 Cas9 TadAins 1252 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 280 - protein, 1533 aa, Artificial Sequence
  Description of artificial sequence: 110.8 Cas9 TadAins delta 59-66 C-truncate 1250 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 281 - protein, 1549 aa, Artificial Sequence
  Description of artificial sequence: 111.1 Cas9 TadAins 997 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 282 - protein, 1555 aa, Artificial Sequence
  Description of artificial sequence: 111.2 Cas9 TadAins 997 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSSGSETPGTSESATPESSGGSSIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 283 - protein, 1421 aa, Artificial Sequence
  Description of artificial sequence: 112 delta HNH TadA polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 284 - protein, 1552 aa, Artificial Sequence
  Description of artificial sequence: 113 N-term single TadA helix trunc 165-end polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 285 - protein, 1545 aa, Artificial Sequence
  Description of artificial sequence: 114 N-term single TadA helix trunc 165-end delta 59-65 polypeptide sequence
MSEVEFSHEYWMRHALTLAKRARDEREVPVGAVLVLNNRVIGEGWNRTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 286 - protein, 1541 aa, Artificial Sequence
  Description of artificial sequence: 115.1 Cas9 TadAins1004 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 287 - protein, 1541 aa, Artificial Sequence
  Description of artificial sequence: 115.2 Cas9 TadAins1005 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 288 - protein, 1541 aa, Artificial Sequence
  Description of artificial sequence: 115.3 Cas9 TadAins1006 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 289 - protein, 1541 aa, Artificial Sequence
  Description of artificial sequence: 115.4 Cas9 TadAins1007 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 290 - protein, 1541 aa, Artificial Sequence
  Description of artificial sequence: 116.1 Cas9 TadAins C-term truncate2 792 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 291 - protein, 1541 aa, Artificial Sequence
  Description of artificial sequence: 116.2 Cas9 TadAins C-term truncate2 791 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 292 - protein, 1541 aa, Artificial Sequence
  Description of artificial sequence: 116.3 Cas9 TadAins C-term truncate2 790 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 293 - protein, 1484 aa, Artificial Sequence
  Description of artificial sequence: 117 Cas9 delta 1017-1069 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 294 - protein, 1554 aa, Artificial Sequence
  Description of artificial sequence: 118 Cas9 TadA-CP116ins 1067 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 295 - protein, 1554 aa, Artificial Sequence
  Description of artificial sequence: 119 Cas9 TadAins 701 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 296 - protein, 1554 aa, Artificial Sequence
  Description of artificial sequence: 120 Cas9 TadACP136ins 1248 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 297 - protein, 1554 aa, Artificial Sequence
  Description of artificial sequence: 121 Cas9 TadACP136ins 1052 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLAMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 298 - protein, 1554 aa, Artificial Sequence
  Description of artificial sequence: 122 Cas9 TadACP136ins 1041 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 299 - protein, 1554 aa, Artificial Sequence
  Description of artificial sequence: 123 Cas9 TadACP139ins 1299 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGDKPIREQAENIIHLFTLTNLGAPAAFKYFDTTIDRKRYTSTKEVLDATLIHQSITGLYETRIDLSQLGGD

SEQ ID NO: 300 - protein, 1454 aa, Artificial Sequence
  Description of artificial sequence: 124 Cas9 delta 792-872 TadAins polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 301 - protein, 1420 aa, Artificial Sequence
  Description of artificial sequence: 125 Cas9 delta 792-906 TadAins polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 302 - protein, 1554 aa, Artificial Sequence
  Description of artificial sequence: 126 TadA CP65ins 1003 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 303 - protein, 1554 aa, Artificial Sequence
  Description of artificial sequence: 127 TadA CP65ins 1016 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 304 - protein, 1554 aa, Artificial Sequence
  Description of artificial sequence: 128 TadA CP65ins 1022 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 305 - protein, 1554 aa, Artificial Sequence
  Description of artificial sequence: 129 TadA CP65ins 1029 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 306 - protein, 1554 aa, Artificial Sequence
  Description of artificial sequence: 130 TadA CP65ins 1041 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 307 - protein, 1554 aa, Artificial Sequence
  Description of artificial sequence: 131 TadA CP65ins 1054 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 308 - protein, 1554 aa, Artificial Sequence
  Description of artificial sequence: 132 TadA CP65ins 1246 polypeptide sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 309 - protein, 160 aa, Staphylococcus aureus
  MISC_FEATURE (1)..(160): TadA polypeptide sequence
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 310 - protein, 161 aa, Bacillus subtilis
  MISC_FEATURE (1)..(161): TadA polypeptide sequence
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 311 - protein, 183 aa, Salmonella typhimurium
  MISC_FEATURE (1)..(183): TadA polypeptide sequence
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 312 - protein, 164 aa, Shewanella putrefaciens
  MISC_FEATURE (1)..(164): TadA polypeptide sequence
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 313 - protein, 173 aa, Haemophilus influenzae
  MISC_FEATURE (1)..(173): TadA polypeptide sequence
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 314 - protein, 161 aa, Caulobacter crescentus
  MISC_FEATURE (1)..(161): TadA polypeptide sequence
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 315 - protein, 179 aa, Geobacter sulfurreducens
  MISC_FEATURE (1)..(179): TadA polypeptide sequence
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 316 - protein, 167 aa, Artificial Sequence
  Description of artificial sequence: TadA*8 polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTD

SEQ ID NO: 317 - RNA, 80 nt, Artificial Sequence
  Description of artificial sequence: gRNA scaffold polynucleotide sequence
guuuuagagcuagaaauagcaaguuaaaauaaggcuaguccguuaucaacuugaaaaaguggcaccgagucggugcuuuu

SEQ ID NO: 318 - RNA, 125 nt, Artificial Sequence
  Description of artificial sequence: gRNA scaffold polynucleotide sequence
guuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 319 - RNA, 76 nt, S. pyogenes
  misc_feature (1)..(76): S. pyogenes gRNA scaffold ologonucleotide sequence
guuuuagagcuagaaauagcaaguuaaaauaaggcuaguccguuaucaacuugaaaaaguggcaccgagucggugc

SEQ ID NO: 320 - RNA, 84 nt, S. aureus
  misc_feature (1)..(84): S. aureus gRNA scaffold oligonucleotide sequence
guuuuaguacucuguaaugaaaauuacagaaucuacuaaaacaaggcaaaaugccguguuuaucucgucaacuuguuggcgaga

SEQ ID NO: 321 - RNA, 97 nt, Bacillus hisashii
  misc_feature (1)..(97): BhCas12b gRNA scaffold oligonucleotide sequence
guucugucuuuuggucaggacaaccgucuagcuauaagugcugcagggugugagaaacuccuauugcuggacgaugucucuuacgaggcauuagcac

SEQ ID NO: 322 - RNA, 88 nt, Bacillus sp.
  misc_feature (1)..(88): BvCas12b gRNA scaffold oligonucleotide sequence
gaccuauagggucaaugaaucugugcgugugccauaaguaauuaaaaauuacccaccacaggagcaccugaaaacaggugcuuggcac

SEQ ID NO: 323 - RNA, 80 nt, Artificial Sequence
  Description of artificial sequence: gRNA scaffold nucleotide sequence; oligonucleotide sequence
  modified_base (78)..(80): um
  misc_feature (78)..(80): In embodiments, a nucleotide(s) is linked to the preceding 5' nucleotide by a 3' phosphorothioate internucleotide liknage
guuuuagagcuagaaauagcaaguuaaaauaaggcuaguccguuaucaacuugaaaaagugggaccgagucggugcuuuu

SEQ ID NO: 324 - RNA, 80 nt, Artificial Sequence; identical to SEQ ID NO: 317
  Description of artificial sequence: gRNA scaffold nucleotide sequence
  misc_feature (78)..(80): In embodiments, a nucleotide(s) is linked to the preceding 5' nucleotide by a 3' phosphorothioate internucleotide liknage
  modified_base (78)..(80): um

SEQ ID NO: 325 - RNA, 117 nt, Bacillus hisashii
  misc_feature (1)..(117): BhCas12b gRNA scaffold + guide sequence; oligonucleotide sequence
  misc_feature (1)..(97): BhCas12b sgRNA scaffold
  misc_feature (98)..(117): n is a, c, g, or u
guucugucuuuuggucaggacaaccgucuagcuauaagugcugcagggugugagaaacuccuauugcuggacgaugucucuuacgaggcauuagcacnnnnnnnnnnnnnnnnnnnn

SEQ ID NO: 326 - RNA, 108 nt, Bacillus sp.
  misc_feature (1)..(108): BvCas12b gRNA scaffold + guide sequence; oligonucleotide sequence
  misc_feature (1)..(88): BvCas12b gRNA scaffold
  misc_feature (89)..(108): n is a, c, g, or u
gaccuauagggucaaugaaucugugcgugugccauaaguaauuaaaaauuacccaccacaggagcaccugaaaacaggugcuuggcacnnnnnnnnnnnnnnnnnnnn

SEQ ID NO: 327 - RNA, 119 nt, Alicyclobacillus acidiphilus
  misc_feature (1)..(119): AaCas12b gRNA scaffold + guide sequence; oligonucleotide sequence
  misc_feature (1)..(99): AaCas12b gRNA scaffold
  misc_feature (100)..(119): n is a, c, g, or u
gucuaaaggacagaauuuuucaacgggugugccaauggccacuuuccagguggcaaagcccguugaacuucucaaaaagaacgaucugagaaguggcacnnnnnnnnnnnnnnnnnnnn

SEQ ID NO: 328 - protein, 29 aa, Artificial Sequence
  Description of artificial sequence: synthetic polypeptide sequence
PKKKRKVEGADKRTADGSEFESPKKKRKV

SEQ ID NO: 329 - protein, 23 aa, Artificial Sequence
  Description of artificial sequence: synthetic peptide sequence
RKSGKIAAIVVKRPRKPKKKRKV

SEQ ID NO: 330 - protein, 8 aa, Artificial Sequence
  Description of artificial sequence: synthetic peptide sequence
SGGSSGGS

SEQ ID NO: 331 - protein, 1609 aa, Artificial Sequence
  Description of artificial sequence: pNMG-B335 ABE8.1_Y147T_CP5_NGC PAM_monomer polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 332 - protein, 1807 aa, Artificial Sequence
  Description of artificial sequence: pNMG-357_ABE8.14 with NGC PAM CP5 polypeptide sequence
  MISC_FEATURE (1)..(174): Adenosine deaminase sequence
  MISC_FEATURE (175)..(198): Linker sequence
  MISC_FEATURE (199)..(365): Adenosine deaminase sequence
  MISC_FEATURE (366)..(397): Linker sequence
  MISC_FEATURE (398)..(738): Sequence derived from Cas9
  MISC_FEATURE (739)..(759): Linker sequence
  MISC_FEATURE (760)..(1785): Sequence derived from Cas9
  MISC_FEATURE (1786)..(1807): Bipartite nuclear localization sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDGGSSGGSSGSETPGTSESATPESSGGSSGGSMSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 333 - protein, 1588 aa, Artificial Sequence
  Description of artificial sequence: ABE8.8-m polypeptide sequence
  MISC_FEATURE (1)..(167): Adenosine deaminase sequence
  MISC_FEATURE (168)..(199): Linker sequence
  MISC_FEATURE (200)..(1566): Sequence derived from Cas9
  MISC_FEATURE (1567)..(1588): Bipartite nuclear localization sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 334 - protein, 1786 aa, Artificial Sequence
  Description of artificial sequence: ABE8.8-d polypeptide sequence
  MISC_FEATURE (1)..(167): Adenosine deaminase sequence
  MISC_FEATURE (168)..(199): Linker sequence
  MISC_FEATURE (200)..(365): Adenosine deaminase sequence
  MISC_FEATURE (366)..(397): Linker sequence
  MISC_FEATURE (398)..(1764): Sequence derived from Cas9
  MISC_FEATURE (1765)..(1786): Bipartite nuclear localization sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 335 - protein, 1588 aa, Artificial Sequence
  Description of artificial sequence: ABE8.13-m polypeptide sequence
  MISC_FEATURE (1)..(167): Adenosine deaminase sequence
  MISC_FEATURE (168)..(199): Linker sequence
  MISC_FEATURE (200)..(1566): Sequence derived from Cas9
  MISC_FEATURE (1567)..(1588): Bipartite nuclear localization sequence
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 336 - protein, 1786 aa, Artificial Sequence
  Description of artificial sequence: ABE8.13-d polypeptide sequence
  MISC_FEATURE (1)..(167): Adenosine deaminase sequence
  MISC_FEATURE (168)..(199): Linker sequence
  MISC_FEATURE (200)..(365): Adenosine deaminase sequence
  MISC_FEATURE (366)..(397): Linker sequence
  MISC_FEATURE (398)..(1764): Sequence derived from Cas9
  MISC_FEATURE (1765)..(1786): Bipartite nuclear localization sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 337 - protein, 1588 aa, Artificial Sequence
  Description of artificial sequence: ABE8.17-m polypeptide sequence
  MISC_FEATURE (1)..(167): Adenosine deaminase sequence
  MISC_FEATURE (168)..(199): Linker sequence
  MISC_FEATURE (200)..(1566): Sequence derived from Cas9
  MISC_FEATURE (1567)..(1588): Bipartite nuclear localization sequence
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 338 - protein, 1786 aa, Artificial Sequence
  Description of artificial sequence: ABE8.17-d polypeptide sequence
  MISC_FEATURE (1)..(167): Adenosine deaminase sequence
  MISC_FEATURE (168)..(199): Linker sequence
  MISC_FEATURE (200)..(365): Adenosine deaminase sequence
  MISC_FEATURE (366)..(397): Linker sequence
  MISC_FEATURE (398)..(1764): Sequence derived from Cas9
  MISC_FEATURE (1765)..(1786): Bipartite nuclear localization sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 339 - protein, 1588 aa, Artificial Sequence
  Description of artificial sequence: ABE8.20-m polypeptide sequence
  MISC_FEATURE (1)..(167): Adenosine deaminse sequence
  MISC_FEATURE (168)..(199): Linker sequence
  MISC_FEATURE (200)..(1566): Sequence derived from Cas9
  MISC_FEATURE (1567)..(1588): Bipartite nuclear localization sequence
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 340 - protein, 1786 aa, Artificial Sequence
  Description of artificial sequence: ABE8.20-d polypeptide sequence
  MISC_FEATURE (1)..(167): Adenosine deaminase sequence
  MISC_FEATURE (168)..(199): Linker sequence
  MISC_FEATURE (200)..(365): Adenosine deaminase sequence
  MISC_FEATURE (366)..(397): Linker sequence
  MISC_FEATURE (398)..(1764): Sequence derived from Cas9
  MISC_FEATURE (1765)..(1786): Bipartite nuclear localization sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 341 - protein, 1588 aa, Artificial Sequence
  Description of artificial sequence: 01. monoABE8.1_bpNLS + Y147T polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 342 - protein, 1588 aa, Artificial Sequence
  Description of artificial sequence: 02. monoABE8.1_bpNLS + Y147R polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 343 - protein, 1588 aa, Artificial Sequence
  Description of artificial sequence: 03. monoABE8.1_bpNLS + Q154S polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 344 - protein, 1588 aa, Artificial Sequence
  Description of artificial sequence: 04. monoABE8.1_bpNLS + Y123H polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 345 - protein, 1588 aa, Artificial Sequence
  Description of artificial sequence: 05. monoABE8.1_bpNLS + V82S polypeptide sequence
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 346 - protein, 1588 aa, Artificial Sequence
  Description of artificial sequence: 06. monoABE8.1_bpNLS + T166R polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 347 - protein, 1588 aa, Artificial Sequence
  Description of artificial sequence: 07. monoABE8.1_bpNLS + Q154R polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 348 - protein, 1588 aa, Artificial Sequence
  Description of artificial sequence: 08. monoABE8.1_bpNLS + Y147R_Q154R_Y123H polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 349 - protein, 1588 aa, Artificial Sequence
  Description of artificial sequence: 09. monoABE8.1_bpNLS + Y147R_Q154R_I76Y polypeptide sequence
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHYPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 350 - protein, 1588 aa, Artificial Sequence
  Description of artificial sequence: 10. monoABE8.1_bpNLS + Y147R_Q154R_T166R polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRRVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 351 - protein, 1588 aa, Artificial Sequence
  Description of artificial sequence: 11. monoABE8.1_bpNLS + Y147T_Q154R polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 352 - protein, 1588 aa, Artificial Sequence
  Description of artificial sequence: 12. monoABE8.1_bpNLS + Y147T_Q154S polypeptide sequence
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 353 - protein, 1588 aa, Artificial Sequence
  Description of artificial sequence: 13. monoABE8.1_bpNLS + H123Y123H_Y147R_Q154R_I76Y polypeptide sequence
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 354 - protein, 1588 aa, Artificial Sequence
  Description of artificial sequence: 14. monoABE8.1_bpNLS + V82S + Q154R polypeptide sequence
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 355 - protein, 4 aa, Artificial Sequence
  Description of artificial sequence: synthetic peptide sequence
SGGS

SEQ ID NO: 356 - protein, 24 aa, Artificial Sequence
  Description of artificial sequence: synthetic peptide sequence
SGGSSGSETPGTSESATPESSGGS

SEQ ID NO: 357 - protein, 32 aa, Artificial Sequence
  Description of artificial sequence: synthetic polypeptide sequence
SGGSSGGSSGSETPGTSESATPESSGGSSGGS

SEQ ID NO: 358 - protein, 104 aa, Artificial Sequence
  Description of artificial sequence: synthetic polypeptide sequence
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 359 - protein, 24 aa, Artificial Sequence
  Description of artificial sequence: synthetic peptide sequence
SGGSSGGSSGSETPGTSESATPES

SEQ ID NO: 360 - protein, 40 aa, Artificial Sequence
  Description of artificial sequence: synthetic polypeptide sequence
SGGSSGGSSGSETPGTSESATPESSGGSSGGSSGGSSGGS

SEQ ID NO: 361 - protein, 64 aa, Artificial Sequence
  Description of artificial sequence: synthetic polypeptide sequence
SGGSSGGSSGSETPGTSESATPESSGGSSGGSSGGSSGGSSGSETPGTSESATPESSGGSSGGS

SEQ ID NO: 362 - protein, 92 aa, Artificial Sequence
  Description of artificial sequence: synthetic polypeptide sequence
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 363 - protein, 5 aa, Artificial Sequence
  Description of artificial sequence: synthetic peptide sequence
PAPAP

SEQ ID NO: 364 - protein, 6 aa, Artificial Sequence
  Description of artificial sequence: synthetic peptide sequence
PAPAPA

SEQ ID NO: 365 - protein, 7 aa, Artificial Sequence
  Description of artificial sequence: synthetic peptide sequence
PAPAPAP

SEQ ID NO: 366 - protein, 8 aa, Artificial Sequence
  Description of artificial sequence: synthetic peptide sequence
PAPAPAPA

SEQ ID NO: 367 - protein, 9 aa, Artificial Sequence
  Description of artificial sequence: synthetic peptide sequence
PAPAPAPAP

SEQ ID NO: 368 - protein, 15 aa, Artificial Sequence
  Description of artificial sequence: synthetic peptide sequence
PAPAPAPAPAPAPAP

SEQ ID NO: 369 - protein, 21 aa, Artificial Sequence
  Description of artificial sequence: synthetic peptide sequence
PAPAPAPAPAPAPAPAPAPAP

SEQ ID NO: 370 - protein, 117 aa, Artificial Sequence
  Description of artificial sequence: synthetic polypeptide sequence
TKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 371 - protein, 72 aa, Artificial Sequence
  Description of artificial sequence: synthetic polypeptide sequence
SDPTTTPAPRPPTPAPTIASQPLSLRPEACRPAAGGAVHTRGLDFACDIYIWAPLAGTCGVLLLSLVITLYC

SEQ ID NO: 372 - protein, 112 aa, Artificial Sequence
  Description of artificial sequence: synthetic polypeptide sequence
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 373 - protein, 41 aa, Artificial Sequence
  Description of artificial sequence: synthetic polypeptide sequence
RSKRSRLLHSDYMNMTPRRPGPTRKHYQPYAPPRDFAAYRS

SEQ ID NO: 374 - protein, 42 aa, Artificial Sequence
  Description of artificial sequence: synthetic polypeptide sequence
KRGRKKLLYIFKQPFMRPVQTTQEEDGCSCRFPEEEEGGCEL

SEQ ID NO: 375 - protein, 47 aa, Artificial Sequence
  Description of artificial sequence: synthetic polypeptide sequence
RFSVVKRGRKKLLYIFKQPFMRPVQTTQEEDGCSCRFPEEEEGGCEL

SEQ ID NO: 376 - protein, 112 aa, Artificial Sequence
  Description of artificial sequence: synthetic polypeptide sequence
DVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELK

SEQ ID NO: 377 - protein, 118 aa, Artificial Sequence
  Description of artificial sequence: synthetic polypeptide sequence
EVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSS

SEQ ID NO: 378 - protein, 112 aa, Artificial Sequence
  Description of artificial sequence: synthetic polypeptide sequence
DVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIK

SEQ ID NO: 379 - protein, 118 aa, Artificial Sequence
  Description of artificial sequence: synthetic polypeptide sequence
QVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSS

SEQ ID NO: 380 - protein, 123 aa, Artificial Sequence
  Description of artificial sequence: synthetic polypeptide sequence
QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSS

SEQ ID NO: 381 - protein, 15 aa, Artificial Sequence
  Description of artificial sequence: synthetic peptide sequence
GGGGSGGGGSGGGGS

SEQ ID NO: 382 - protein, 245 aa, Artificial Sequence
  Description of artificial sequence: synthetic polypeptide sequence
DVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELKGGGGSGGGGSGGGGSEVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSS

SEQ ID NO: 383 - protein, 245 aa, Artificial Sequence
  Description of artificial sequence: synthetic polypeptide sequence
EVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSSGGGGSGGGGSGGGGSDVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELK

SEQ ID NO: 384 - protein, 245 aa, Artificial Sequence
  Description of artificial sequence: synthetic polypeptide sequence
DVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKGGGGSGGGGSGGGGSQVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSS

SEQ ID NO: 385 - protein, 245 aa, Artificial Sequence
  Description of artificial sequence: synthetic polypeptide sequence
QVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSSGGGGSGGGGSGGGGSDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIK

SEQ ID NO: 386 - protein, 250 aa, Artificial Sequence
  Description of artificial sequence: synthetic polypeptide sequence
DVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSS

SEQ ID NO: 387 - protein, 250 aa, Artificial Sequence
  Description of artificial sequence: synthetic polypeptide sequence
QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSSGGGGSGGGGSGGGGSDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIK

SEQ ID NO: 388 - RNA, 20 nt, Artificial Sequence
  Description of artificial sequence: synthetic oligonucleotide sequence
cuugggucaggacaucaacu

SEQ ID NO: 389 - RNA, 20 nt, Artificial Sequence
  Description of artificial sequence: synthetic oligonucleotide sequence
cgaugaucaggauaucuaca

SEQ ID NO: 390 - RNA, 20 nt, Artificial Sequence
  Description of artificial sequence: synthetic oligonucleotide sequence
cacgcaccuggacagcugac

SEQ ID NO: 391 - RNA, 20 nt, Artificial Sequence
  Description of artificial sequence: synthetic oligonucleotide sequence
aaacagaggagucggagaaa

SEQ ID NO: 392 - RNA, 20 nt, Artificial Sequence
  Description of artificial sequence: synthetic oligonucleotide sequence
acacaaguucaccagcagaa

SEQ ID NO: 393 - RNA, 20 nt, Artificial Sequence
  Description of artificial sequence: synthetic oligonucleotide sequence
guucagccaaaaccucccca

SEQ ID NO: 394 - RNA, 20 nt, Artificial Sequence
  Description of artificial sequence: synthetic oligonucleotide sequence
auacaaguccaggagaucuu

SEQ ID NO: 395 - RNA, 20 nt, Artificial Sequence
  Description of artificial sequence: synthetic oligonucleotide sequence
uucagcaccagccucagaag

SEQ ID NO: 396 - RNA, 20 nt, Artificial Sequence
  Description of artificial sequence: synthetic oligonucleotide sequence
acucacgcuggauagccucc

SEQ ID NO: 397 - RNA, 20 nt, Artificial Sequence
  Description of artificial sequence: synthetic oligonucleotide sequence
ccacacccaaaaggccacac

SEQ ID NO: 398 - RNA, 20 nt, Artificial Sequence
  Description of artificial sequence: synthetic oligonucleotide sequence
cccaccagcucagcuccacg

SEQ ID NO: 399 - RNA, 20 nt, Artificial Sequence
  Description of artificial sequence: synthetic oligonucleotide sequence
cgcugucaaguccaguucua

SEQ ID NO: 400 - RNA, 20 nt, Artificial Sequence
  Description of artificial sequence: synthetic oligonucleotide sequence
gcugucaaguccaguucuac

SEQ ID NO: 401 - RNA, 20 nt, Artificial Sequence
  Description of artificial sequence: synthetic oligonucleotide sequence
cacccagaucgucagcgccg

SEQ ID NO: 402 - RNA, 20 nt, Artificial Sequence
  Description of artificial sequence: synthetic oligonucleotide sequence
ccacucaccugcucuacccc

SEQ ID NO: 403 - RNA, 20 nt, Artificial Sequence
  Description of artificial sequence: synthetic oligonucleotide sequence
gcuacaaacaagcucaucuu

SEQ ID NO: 404 - RNA, 20 nt, Artificial Sequence
  Description of artificial sequence: synthetic oligonucleotide sequence
ccagccaaguacguaaguag

SEQ ID NO: 405 - RNA, 20 nt, Artificial Sequence
  Description of artificial sequence: synthetic oligonucleotide sequence
cuggauaucugugggacaag

SEQ ID NO: 406 - RNA, 20 nt, Artificial Sequence
  Description of artificial sequence: synthetic oligonucleotide sequence
cuuaccugggcuggggaaga

SEQ ID NO: 407 - RNA, 20 nt, Artificial Sequence
  Description of artificial sequence: synthetic oligonucleotide sequence
uucguaucuguaaaaccaag

SEQ ID NO: 408 - RNA, 20 nt, Artificial Sequence
  Description of artificial sequence: synthetic oligonucleotide sequence
uuucaaaaccugucagugau

SEQ ID NO: 409 - RNA, 20 nt, Artificial Sequence
  Description of artificial sequence: synthetic oligonucleotide sequence
uucaaaaccugucagugauu

SEQ ID NO: 410 - RNA, 20 nt, Artificial Sequence
  Description of artificial sequence: synthetic oligonucleotide sequence
acgacuggccagggcgccug

SEQ ID NO: 411 - RNA, 20 nt, Artificial Sequence
  Description of artificial sequence: synthetic oligonucleotide sequence
caccgcccagacgacuggcc

SEQ ID NO: 412 - RNA, 20 nt, Artificial Sequence
  Description of artificial sequence: synthetic oligonucleotide sequence
cuacaacugggcuggcggcc

SEQ ID NO: 413 - RNA, 20 nt, Artificial Sequence
  Description of artificial sequence: synthetic oligonucleotide sequence
caccuaccuaagaaccaucc

SEQ ID NO: 414 - RNA, 20 nt, Artificial Sequence
  Description of artificial sequence: synthetic oligonucleotide sequence
ggagucugagagauggagag

SEQ ID NO: 415 - RNA, 20 nt, Artificial Sequence
  Description of artificial sequence: synthetic oligonucleotide sequence
cagcaaccagacggacaagc

SEQ ID NO: 416 - RNA, 20 nt, Artificial Sequence
  Description of artificial sequence: synthetic oligonucleotide sequence
gugucacacaacugcccaac

SEQ ID NO: 417 - RNA, 20 nt, Artificial Sequence
  Description of artificial sequence: synthetic oligonucleotide sequence
agccggccaguuccaaaccc

SEQ ID NO: 418 - RNA, 20 nt, Artificial Sequence
  Description of artificial sequence: synthetic oligonucleotide sequence
caguuccaaacccugguggu

SEQ ID NO: 419 - RNA, 20 nt, Artificial Sequence
  Description of artificial sequence: synthetic oligonucleotide sequence
cggccaguuccaaacccugg

SEQ ID NO: 420 - RNA, 20 nt, Artificial Sequence
  Description of artificial sequence: synthetic oligonucleotide sequence
ggacccagacuagcagcacc

SEQ ID NO: 421 - RNA, 20 nt, Artificial Sequence
  Description of artificial sequence: synthetic oligonucleotide sequence
gacguuaccucgugcggccc

SEQ ID NO: 422 - RNA, 20 nt, Artificial Sequence
  Description of artificial sequence: synthetic oligonucleotide sequence
ucccugcagagaaacacacu

SEQ ID NO: 423 - RNA, 20 nt, Artificial Sequence
  Description of artificial sequence: synthetic oligonucleotide sequence
gagacucaccaggggcuggc

SEQ ID NO: 424 - RNA, 20 nt, Artificial Sequence
  Description of artificial sequence: synthetic oligonucleotide sequence
ccuccuucuuugaggagaaa

SEQ ID NO: 425 - RNA, 20 nt, Artificial Sequence
  Description of artificial sequence: synthetic oligonucleotide sequence
gggguuccagggccugucug

SEQ ID NO: 426 - RNA, 20 nt, Artificial Sequence
  Description of artificial sequence: synthetic oligonucleotide sequence
uucucucuggaagggcacaa

SEQ ID NO: 427 - RNA, 20 nt, Artificial Sequence
  Description of artificial sequence: synthetic oligonucleotide sequence
ccaguggcgagagaagaccc

SEQ ID NO: 428 - RNA, 20 nt, Artificial Sequence
  Description of artificial sequence: synthetic oligonucleotide sequence
ugcccagccacugaggccug

SEQ ID NO: 429 - RNA, 20 nt, Artificial Sequence
  Description of artificial sequence: synthetic oligonucleotide sequence
cgacuggccagggcgccugu

SEQ ID NO: 430 - RNA, 20 nt, Artificial Sequence
  Description of artificial sequence: synthetic oligonucleotide sequence
accgcccagacgacuggcca

SEQ ID NO: 431 - RNA, 20 nt, Artificial Sequence
  Description of artificial sequence: synthetic oligonucleotide sequence
uggaguaccugaggaauauc

SEQ ID NO: 432 - RNA, 20 nt, Artificial Sequence
  Description of artificial sequence: synthetic oligonucleotide sequence
uuaccccacuuaacuaucuu

SEQ ID NO: 433 - RNA, 20 nt, Artificial Sequence
  Description of artificial sequence: synthetic oligonucleotide sequence
ucgaucuaugaaaaagacag

SEQ ID NO: 434 - RNA, 18 nt, Artificial Sequence
  Description of artificial sequence: synthetic oligonucleotide sequence
uaccccacuuaacuaucu

SEQ ID NO: 435 - RNA, 20 nt, Artificial Sequence
  Description of artificial sequence: synthetic oligonucleotide sequence
cucagguacuccaaagauuc

SEQ ID NO: 436 - RNA, 20 nt, Artificial Sequence
  Description of artificial sequence: synthetic oligonucleotide sequence
cuuaccccacuuaacuaucu

SEQ ID NO: 437 - RNA, 20 nt, Artificial Sequence
  Description of artificial sequence: synthetic oligonucleotide sequence
uuuuaccuuggggcucugac

SEQ ID NO: 438 - RNA, 20 nt, Artificial Sequence
  Description of artificial sequence: synthetic oligonucleotide sequence
agccccaagguaaaaaggcc

SEQ ID NO: 439 - RNA, 20 nt, Artificial Sequence
  Description of artificial sequence: synthetic oligonucleotide sequence
gagccccaagguaaaaaggc

SEQ ID NO: 440 - RNA, 20 nt, Artificial Sequence
  Description of artificial sequence: synthetic oligonucleotide sequence
cagcucacagugugccacca

SEQ ID NO: 441 - RNA, 20 nt, Artificial Sequence
  Description of artificial sequence: synthetic oligonucleotide sequence
uaugaccagauggaccuggc

SEQ ID NO: 442 - RNA, 20 nt, Artificial Sequence
  Description of artificial sequence: synthetic oligonucleotide sequence
acuggaccaguaugucuucc

SEQ ID NO: 443 - RNA, 20 nt, Artificial Sequence
  Description of artificial sequence: synthetic oligonucleotide sequence
ugucuuccaggacucccagc

SEQ ID NO: 444 - RNA, 20 nt, Artificial Sequence
  Description of artificial sequence: synthetic oligonucleotide sequence
uucaaccaggagccagccuc

SEQ ID NO: 445 - RNA, 20 nt, Artificial Sequence
  Description of artificial sequence: synthetic oligonucleotide sequence
gaccagauucccaguauguu

SEQ ID NO: 446 - RNA, 20 nt, Artificial Sequence
  Description of artificial sequence: synthetic oligonucleotide sequence
uaacauacugggaaucuggu

SEQ ID NO: 447 - RNA, 20 nt, Artificial Sequence
  Description of artificial sequence: synthetic oligonucleotide sequence
aaaggcacugcaagagacaa

SEQ ID NO: 448 - RNA, 20 nt, Artificial Sequence
  Description of artificial sequence: synthetic oligonucleotide sequence
cucuggcaaaucucugaggc

SEQ ID NO: 449 - RNA, 20 nt, Artificial Sequence
  Description of artificial sequence: synthetic oligonucleotide sequence
agccaaguacccccucccag

SEQ ID NO: 450 - RNA, 20 nt, Artificial Sequence
  Description of artificial sequence: synthetic oligonucleotide sequence
accucccgagcaaacaugac

SEQ ID NO: 451 - RNA, 20 nt, Artificial Sequence
  Description of artificial sequence: synthetic oligonucleotide sequence
ccuuaccugucauguuugcu

SEQ ID NO: 452 - RNA, 20 nt, Artificial Sequence
  Description of artificial sequence: synthetic oligonucleotide sequence
ugcucuggagauggagaagc

SEQ ID NO: 453 - RNA, 20 nt, Artificial Sequence
  Description of artificial sequence: synthetic oligonucleotide sequence
cccacccaaugcccggcagc

SEQ ID NO: 454 - RNA, 20 nt, Artificial Sequence
  Description of artificial sequence: synthetic oligonucleotide sequence
aggccauuuuggaagcuugu

SEQ ID NO: 455 - RNA, 20 nt, Artificial Sequence
  Description of artificial sequence: synthetic oligonucleotide sequence
accggcucugcaaaggccag

SEQ ID NO: 456 - RNA, 20 nt, Artificial Sequence
  Description of artificial sequence: synthetic oligonucleotide sequence
uggugcaggccaggcuggag

SEQ ID NO: 457 - RNA, 20 nt, Artificial Sequence
  Description of artificial sequence: synthetic oligonucleotide sequence
gaacggcagcuggcccaagg

SEQ ID NO: 458 - RNA, 20 nt, Artificial Sequence
  Description of artificial sequence: synthetic oligonucleotide sequence
ggcccaaggaggccuggcug

SEQ ID NO: 459 - RNA, 20 nt, Artificial Sequence
  Description of artificial sequence: synthetic oligonucleotide sequence
gacacgagugauugcugugc

SEQ ID NO: 460 - RNA, 20 nt, Artificial Sequence
  Description of artificial sequence: synthetic oligonucleotide sequence
cuggucagggcaagagcuau

SEQ ID NO: 461 - RNA, 20 nt, Artificial Sequence
  Description of artificial sequence: synthetic oligonucleotide sequence
gggcccacagccacucgugg

SEQ ID NO: 462 - RNA, 20 nt, Artificial Sequence
  Description of artificial sequence: synthetic oligonucleotide sequence
uuccagaagaagcugcuccg

SEQ ID NO: 463 - RNA, 20 nt, Artificial Sequence
  Description of artificial sequence: synthetic oligonucleotide sequence
ccugguccagagccugagca

SEQ ID NO: 464 - RNA, 20 nt, Artificial Sequence
  Description of artificial sequence: synthetic oligonucleotide sequence
cagacaucaaaguacccuac

SEQ ID NO: 465 - RNA, 20 nt, Artificial Sequence
  Description of artificial sequence: synthetic oligonucleotide sequence
acaucaaaguacccuacagg

SEQ ID NO: 466 - RNA, 20 nt, Artificial Sequence
  Description of artificial sequence: synthetic oligonucleotide sequence
cgcccagguccucacgucug

SEQ ID NO: 467 - RNA, 20 nt, Artificial Sequence
  Description of artificial sequence: synthetic oligonucleotide sequence
cuuaguccaacacccaccgc

SEQ ID NO: 468 - RNA, 20 nt, Artificial Sequence
  Description of artificial sequence: synthetic oligonucleotide sequence
ccuccugcaaugcuuccugg

SEQ ID NO: 469 - RNA, 20 nt, Artificial Sequence
  Description of artificial sequence: synthetic oligonucleotide sequence
gagccagccacagggccccc

SEQ ID NO: 470 - RNA, 20 nt, Artificial Sequence
  Description of artificial sequence: synthetic oligonucleotide sequence
ggaagcagaaggugcuugcg

SEQ ID NO: 471 - RNA, 20 nt, Artificial Sequence
  Description of artificial sequence: synthetic oligonucleotide sequence
ggcugcagccggggacacug

SEQ ID NO: 472 - RNA, 20 nt, Artificial Sequence
  Description of artificial sequence: synthetic oligonucleotide sequence
cugccaaauuccagccuccu

SEQ ID NO: 473 - RNA, 20 nt, Artificial Sequence
  Description of artificial sequence: synthetic oligonucleotide sequence
ggcgggccaagacuucuccc

SEQ ID NO: 474 - RNA, 20 nt, Artificial Sequence
  Description of artificial sequence: synthetic oligonucleotide sequence
agacucagaggugagaggag

SEQ ID NO: 475 - RNA, 20 nt, Artificial Sequence
  Description of artificial sequence: synthetic oligonucleotide sequence
agccuaggaggcaaagagca

SEQ ID NO: 476 - RNA, 20 nt, Artificial Sequence
  Description of artificial sequence: synthetic oligonucleotide sequence
cccccaggcuuuccccaaac

SEQ ID NO: 477 - RNA, 20 nt, Artificial Sequence
  Description of artificial sequence: synthetic oligonucleotide sequence
ucacuccagaugcugcaggg

SEQ ID NO: 478 - RNA, 20 nt, Artificial Sequence
  Description of artificial sequence: synthetic oligonucleotide sequence
aggcugcagguggaaucaga

SEQ ID NO: 479 - RNA, 20 nt, Artificial Sequence
  Description of artificial sequence: synthetic oligonucleotide sequence
cuucccccagcugaaguccu

SEQ ID NO: 480 - RNA, 20 nt, Artificial Sequence
  Description of artificial sequence: synthetic oligonucleotide sequence
cacucacuugaggguuucca

SEQ ID NO: 481 - RNA, 20 nt, Artificial Sequence
  Description of artificial sequence: synthetic oligonucleotide sequence
cagacugcggggacacagug

SEQ ID NO: 482 - RNA, 20 nt, Artificial Sequence
  Description of artificial sequence: synthetic oligonucleotide sequence
ccacucaccuuagccugagc

SEQ ID NO: 483 - RNA, 20 nt, Artificial Sequence
  Description of artificial sequence: synthetic oligonucleotide sequence
cacucaccuuagccugagca

SEQ ID NO: 484 - RNA, 20 nt, Artificial Sequence
  Description of artificial sequence: synthetic oligonucleotide sequence
guacaagcugucggaaacag

SEQ ID NO: 485 - RNA, 20 nt, Artificial Sequence
  Description of artificial sequence: synthetic oligonucleotide sequence
acacucacuccaucacccgg

SEQ ID NO: 486 - RNA, 20 nt, Artificial Sequence
  Description of artificial sequence: synthetic oligonucleotide sequence
cacucacuccaucacccgga

SEQ ID NO: 487 - RNA, 20 nt, Artificial Sequence
  Description of artificial sequence: synthetic oligonucleotide sequence
cguccaguacaacaaguuca

SEQ ID NO: 488 - RNA, 20 nt, Artificial Sequence
  Description of artificial sequence: synthetic oligonucleotide sequence
ccacauccugcaagggggga

SEQ ID NO: 489 - RNA, 20 nt, Artificial Sequence
  Description of artificial sequence: synthetic oligonucleotide sequence
cacauccugcaaggggggau

SEQ ID NO: 490 - RNA, 20 nt, Artificial Sequence
  Description of artificial sequence: synthetic oligonucleotide sequence
ugggcguccacauccugcaa

SEQ ID NO: 491 - RNA, 20 nt, Artificial Sequence
  Description of artificial sequence: synthetic oligonucleotide sequence
gggcguccacauccugcaag

SEQ ID NO: 492 - RNA, 20 nt, Artificial Sequence
  Description of artificial sequence: synthetic oligonucleotide sequence
ggcguccacauccugcaagg

SEQ ID NO: 493 - RNA, 20 nt, Artificial Sequence
  Description of artificial sequence: synthetic oligonucleotide sequence
gcguccacauccugcaaggg

SEQ ID NO: 494 - RNA, 20 nt, Artificial Sequence
  Description of artificial sequence: synthetic oligonucleotide sequence
gcccaagguaagagcuuccc

SEQ ID NO: 495 - RNA, 20 nt, Artificial Sequence
  Description of artificial sequence: synthetic oligonucleotide sequence
gcucuuaccuugggcagcca

SEQ ID NO: 496 - RNA, 20 nt, Artificial Sequence
  Description of artificial sequence: synthetic oligonucleotide sequence
agcucuuaccuugggcagcc

SEQ ID NO: 497 - RNA, 20 nt, Artificial Sequence
  Description of artificial sequence: synthetic oligonucleotide sequence
ugcaccucuggggaggaccu

SEQ ID NO: 498 - RNA, 20 nt, Artificial Sequence
  Description of artificial sequence: synthetic oligonucleotide sequence
cugcaccucuggggaggacc

SEQ ID NO: 499 - RNA, 20 nt, Artificial Sequence
  Description of artificial sequence: synthetic oligonucleotide sequence
cgccugcagcugucggacac

SEQ ID NO: 500 - RNA, 20 nt, Artificial Sequence
  Description of artificial sequence: synthetic oligonucleotide sequence
caccugccaggccaucacgg

SEQ ID NO: 501 - RNA, 20 nt, Artificial Sequence
  Description of artificial sequence: synthetic oligonucleotide sequence
cccuaccugucaccaggacc

SEQ ID NO: 502 - RNA, 20 nt, Artificial Sequence
  Description of artificial sequence: synthetic oligonucleotide sequence
ccuaccugucaccaggacca

SEQ ID NO: 503 - RNA, 20 nt, Artificial Sequence
  Description of artificial sequence: synthetic oligonucleotide sequence
ccucugagaaggaaaaaaga

SEQ ID NO: 504 - RNA, 20 nt, Artificial Sequence
  Description of artificial sequence: synthetic oligonucleotide sequence
cagaggaacagucccaagga

SEQ ID NO: 505 - RNA, 20 nt, Artificial Sequence
  Description of artificial sequence: synthetic oligonucleotide sequence
guacagguaagagcaacgcc

SEQ ID NO: 506 - RNA, 20 nt, Artificial Sequence
  Description of artificial sequence: synthetic oligonucleotide sequence
cucuuaccuguaccauaacc

SEQ ID NO: 507 - RNA, 20 nt, Artificial Sequence
  Description of artificial sequence: synthetic oligonucleotide sequence
uuaccuguaccauaaccagg

SEQ ID NO: 508 - RNA, 20 nt, Artificial Sequence
  Description of artificial sequence: synthetic oligonucleotide sequence
uguaucuguaggaggagaag

SEQ ID NO: 509 - RNA, 20 nt, Artificial Sequence
  Description of artificial sequence: synthetic oligonucleotide sequence
guaucuguaggaggagaagu

SEQ ID NO: 510 - RNA, 20 nt, Artificial Sequence
  Description of artificial sequence: synthetic oligonucleotide sequence
cagauacaaacuggacucuc

SEQ ID NO: 511 - RNA, 20 nt, Artificial Sequence
  Description of artificial sequence: synthetic oligonucleotide sequence
ucucaaaaccaaagaucucc

SEQ ID NO: 512 - RNA, 20 nt, Artificial Sequence
  Description of artificial sequence: synthetic oligonucleotide sequence
caacacaacccugaccugug

SEQ ID NO: 513 - RNA, 20 nt, Artificial Sequence
  Description of artificial sequence: synthetic oligonucleotide sequence
ucaccaaaaggaaaaaacag

SEQ ID NO: 514 - RNA, 20 nt, Artificial Sequence
  Description of artificial sequence: synthetic oligonucleotide sequence
ccacagucugaaagaaagca

SEQ ID NO: 515 - RNA, 20 nt, Artificial Sequence
  Description of artificial sequence: synthetic oligonucleotide sequence
gacacuguuggcacggagga

SEQ ID NO: 516 - RNA, 20 nt, Artificial Sequence
  Description of artificial sequence: synthetic oligonucleotide sequence
uuaccauggccaucaacaca

SEQ ID NO: 517 - RNA, 20 nt, Artificial Sequence
  Description of artificial sequence: synthetic oligonucleotide sequence
ccacagucugaaagaaaaca

SEQ ID NO: 518 - RNA, 20 nt, Artificial Sequence
  Description of artificial sequence: synthetic oligonucleotide sequence
cacagucugaaagaaaacag

SEQ ID NO: 519 - RNA, 20 nt, Artificial Sequence
  Description of artificial sequence: synthetic oligonucleotide sequence
uuaccauggccaucagcacg

SEQ ID NO: 520 - RNA, 20 nt, Artificial Sequence
  Description of artificial sequence: synthetic oligonucleotide sequence
gggucauaccagcugagccg

SEQ ID NO: 521 - RNA, 20 nt, Artificial Sequence
  Description of artificial sequence: synthetic oligonucleotide sequence
uggaaaucugggggucagaa

SEQ ID NO: 522 - RNA, 20 nt, Artificial Sequence
  Description of artificial sequence: synthetic oligonucleotide sequence
guuacccaccuaagcagguc

SEQ ID NO: 523 - RNA, 20 nt, Artificial Sequence
  Description of artificial sequence: synthetic oligonucleotide sequence
ucugccagcggcugaacugu

SEQ ID NO: 524 - RNA, 20 nt, Artificial Sequence
  Description of artificial sequence: synthetic oligonucleotide sequence
cugccagcggcugaacugug

SEQ ID NO: 525 - RNA, 20 nt, Artificial Sequence
  Description of artificial sequence: synthetic oligonucleotide sequence
ccucccacugcuuggagcuc

SEQ ID NO: 526 - RNA, 20 nt, Artificial Sequence
  Description of artificial sequence: synthetic oligonucleotide sequence
gaagugccagggccagcugg

SEQ ID NO: 527 - RNA, 20 nt, Artificial Sequence
  Description of artificial sequence: synthetic oligonucleotide sequence
ccaugugccauccguccuug

SEQ ID NO: 528 - RNA, 20 nt, Artificial Sequence
  Description of artificial sequence: synthetic oligonucleotide sequence
uuugcagccagagcuggggc

SEQ ID NO: 529 - RNA, 20 nt, Artificial Sequence
  Description of artificial sequence: synthetic oligonucleotide sequence
gguucugcaaugagacacuc

SEQ ID NO: 530 - RNA, 20 nt, Artificial Sequence
  Description of artificial sequence: synthetic oligonucleotide sequence
cuccagagcccacagguaag

SEQ ID NO: 531 - RNA, 20 nt, Artificial Sequence
  Description of artificial sequence: synthetic oligonucleotide sequence
accacaacuccagagcccac

SEQ ID NO: 532 - RNA, 20 nt, Artificial Sequence
  Description of artificial sequence: synthetic oligonucleotide sequence
gagcuaggagaggagagagc

SEQ ID NO: 533 - RNA, 20 nt, Artificial Sequence
  Description of artificial sequence: synthetic oligonucleotide sequence
cucacuuaccugagcaaagg

SEQ ID NO: 534 - RNA, 20 nt, Artificial Sequence
  Description of artificial sequence: synthetic oligonucleotide sequence
cugcagcugguggcacaguc

SEQ ID NO: 535 - RNA, 20 nt, Artificial Sequence
  Description of artificial sequence: synthetic oligonucleotide sequence
gaucuuccauuggauuggca

SEQ ID NO: 536 - RNA, 20 nt, Artificial Sequence
  Description of artificial sequence: synthetic oligonucleotide sequence
ugaggcccaggacaagaccc

SEQ ID NO: 537 - RNA, 20 nt, Artificial Sequence
  Description of artificial sequence: synthetic oligonucleotide sequence
aaaccugagaggggaagcaa

SEQ ID NO: 538 - RNA, 20 nt, Artificial Sequence
  Description of artificial sequence: synthetic oligonucleotide sequence
cucccaccgcagcgagcucc

SEQ ID NO: 539 - RNA, 20 nt, Artificial Sequence
  Description of artificial sequence: synthetic oligonucleotide sequence
uuuccagcccaaggugcaga

SEQ ID NO: 540 - RNA, 20 nt, Artificial Sequence
  Description of artificial sequence: synthetic oligonucleotide sequence
ggugcagagccgucuggugg

SEQ ID NO: 541 - RNA, 20 nt, Artificial Sequence
  Description of artificial sequence: synthetic oligonucleotide sequence
aggugcagagccgucuggug

SEQ ID NO: 542 - RNA, 20 nt, Artificial Sequence
  Description of artificial sequence: synthetic oligonucleotide sequence
uccuaucgagugcuggacgc

SEQ ID NO: 543 - RNA, 20 nt, Artificial Sequence
  Description of artificial sequence: synthetic oligonucleotide sequence
aaggugcagagccgucuggu

SEQ ID NO: 544 - RNA, 20 nt, Artificial Sequence
  Description of artificial sequence: synthetic oligonucleotide sequence
caaggugcagagccgucugg

SEQ ID NO: 545 - RNA, 20 nt, Artificial Sequence
  Description of artificial sequence: synthetic oligonucleotide sequence
gggcugcccacugagccccc

SEQ ID NO: 546 - RNA, 20 nt, Artificial Sequence
  Description of artificial sequence: synthetic oligonucleotide sequence
aggugcgccagggggcucag

SEQ ID NO: 547 - RNA, 20 nt, Artificial Sequence
  Description of artificial sequence: synthetic oligonucleotide sequence
ggccaggauccaaaccccgc

SEQ ID NO: 548 - RNA, 20 nt, Artificial Sequence
  Description of artificial sequence: synthetic oligonucleotide sequence
cgccaguggauuggcccaac

SEQ ID NO: 549 - RNA, 20 nt, Artificial Sequence
  Description of artificial sequence: synthetic oligonucleotide sequence
gcgccaguggauuggcccaa

SEQ ID NO: 550 - RNA, 20 nt, Artificial Sequence
  Description of artificial sequence: synthetic oligonucleotide sequence
aagaagcagcgccaguggau

SEQ ID NO: 551 - RNA, 20 nt, Artificial Sequence
  Description of artificial sequence: synthetic oligonucleotide sequence
gcuuaccuggauaagcugac

SEQ ID NO: 552 - RNA, 20 nt, Artificial Sequence
  Description of artificial sequence: synthetic oligonucleotide sequence
aaagacacugggcagauggu

SEQ ID NO: 553 - RNA, 20 nt, Artificial Sequence
  Description of artificial sequence: synthetic oligonucleotide sequence
uuccagagcuggggaaagaa

SEQ ID NO: 554 - RNA, 20 nt, Artificial Sequence
  Description of artificial sequence: synthetic oligonucleotide sequence
acucacccagcauccccagc

SEQ ID NO: 555 - RNA, 20 nt, Artificial Sequence
  Description of artificial sequence: synthetic oligonucleotide sequence
agcgacugcagaaagaagag

SEQ ID NO: 556 - RNA, 20 nt, Artificial Sequence
  Description of artificial sequence: synthetic oligonucleotide sequence
cauaccagcugagccguccg

SEQ ID NO: 557 - RNA, 20 nt, Artificial Sequence
  Description of artificial sequence: synthetic oligonucleotide sequence
ccugcagagaaacacacuug

SEQ ID NO: 558 - DNA, 20 bp, Artificial Sequence
  Description of artificial sequence: synthetic oligonucleotide sequence
cttgggtcaggacatcaact

SEQ ID NO: 559 - DNA, 20 bp, Artificial Sequence
  Description of artificial sequence: synthetic oligonucleotide sequence
cgatgatcaggatatctaca

SEQ ID NO: 560 - DNA, 20 bp, Artificial Sequence
  Description of artificial sequence: synthetic oligonucleotide sequence
cacgcacctggacagctgac

SEQ ID NO: 561 - DNA, 20 bp, Artificial Sequence
  Description of artificial sequence: synthetic oligonucleotide sequence
aaacagaggagtcggagaaa

SEQ ID NO: 562 - DNA, 20 bp, Artificial Sequence
  Description of artificial sequence: synthetic oligonucleotide sequence
acacaagttcaccagcagaa

SEQ ID NO: 563 - DNA, 20 bp, Artificial Sequence
  Description of artificial sequence: synthetic oligonucleotide sequence
gttcagccaaaacctcccca

SEQ ID NO: 564 - DNA, 20 bp, Artificial Sequence
  Description of artificial sequence: synthetic oligonucleotide sequence
atacaagtccaggagatctt

SEQ ID NO: 565 - DNA, 20 bp, Artificial Sequence
  Description of artificial sequence: synthetic oligonucleotide sequence
ttcagcaccagcctcagaag

SEQ ID NO: 566 - DNA, 20 bp, Artificial Sequence
  Description of artificial sequence: synthetic oligonucleotide sequence
actcacgctggatagcctcc

SEQ ID NO: 567 - DNA, 20 bp, Artificial Sequence
  Description of artificial sequence: synthetic oligonucleotide sequence
ccacacccaaaaggccacac

SEQ ID NO: 568 - DNA, 20 bp, Artificial Sequence
  Description of artificial sequence: synthetic oligonucleotide sequence
cccaccagctcagctccacg

SEQ ID NO: 569 - DNA, 20 bp, Artificial Sequence
  Description of artificial sequence: synthetic oligonucleotide sequence
cgctgtcaagtccagttcta

SEQ ID NO: 570 - DNA, 20 bp, Artificial Sequence
  Description of artificial sequence: synthetic oligonucleotide sequence
gctgtcaagtccagttctac

SEQ ID NO: 571 - DNA, 20 bp, Artificial Sequence
  Description of artificial sequence: synthetic oligonucleotide sequence
cacccagatcgtcagcgccg

SEQ ID NO: 572 - DNA, 20 bp, Artificial Sequence
  Description of artificial sequence: synthetic oligonucleotide sequence
ccactcacctgctctacccc

SEQ ID NO: 573 - DNA, 20 bp, Artificial Sequence
  Description of artificial sequence: synthetic oligonucleotide sequence
gctacaaacaagctcatctt

SEQ ID NO: 574 - DNA, 20 bp, Artificial Sequence
  Description of artificial sequence: synthetic oligonucleotide sequence
ccagccaagtacgtaagtag

SEQ ID NO: 575 - DNA, 20 bp, Artificial Sequence
  Description of artificial sequence: synthetic oligonucleotide sequence
ctggatatctgtgggacaag

SEQ ID NO: 576 - DNA, 20 bp, Artificial Sequence
  Description of artificial sequence: synthetic oligonucleotide sequence
cttacctgggctggggaaga

SEQ ID NO: 577 - DNA, 20 bp, Artificial Sequence
  Description of artificial sequence: synthetic oligonucleotide sequence
ttcgtatctgtaaaaccaag

SEQ ID NO: 578 - DNA, 20 bp, Artificial Sequence
  Description of artificial sequence: synthetic oligonucleotide sequence
tttcaaaacctgtcagtgat

SEQ ID NO: 579 - DNA, 20 bp, Artificial Sequence
  Description of artificial sequence: synthetic oligonucleotide sequence
ttcaaaacctgtcagtgatt

SEQ ID NO: 580 - DNA, 20 bp, Artificial Sequence
  Description of artificial sequence: synthetic oligonucleotide sequence
acgactggccagggcgcctg

SEQ ID NO: 581 - DNA, 20 bp, Artificial Sequence
  Description of artificial sequence: synthetic oligonucleotide sequence
caccgcccagacgactggcc

SEQ ID NO: 582 - DNA, 20 bp, Artificial Sequence
  Description of artificial sequence: synthetic oligonucleotide sequence
ctacaactgggctggcggcc

SEQ ID NO: 583 - DNA, 20 bp, Artificial Sequence
  Description of artificial sequence: synthetic oligonucleotide sequence
cacctacctaagaaccatcc

SEQ ID NO: 584 - DNA, 20 bp, Artificial Sequence
  Description of artificial sequence: synthetic oligonucleotide sequence
ggagtctgagagatggagag

SEQ ID NO: 585 - DNA, 20 bp, Artificial Sequence
  Description of artificial sequence: synthetic oligonucleotide sequence
cagcaaccagacggacaagc

SEQ ID NO: 586 - DNA, 20 bp, Artificial Sequence
  Description of artificial sequence: synthetic oligonucleotide sequence
gtgtcacacaactgcccaac

SEQ ID NO: 587 - DNA, 20 bp, Artificial Sequence
  Description of artificial sequence: synthetic oligonucleotide sequence
agccggccagttccaaaccc

SEQ ID NO: 588 - DNA, 20 bp, Artificial Sequence
  Description of artificial sequence: synthetic oligonucleotide sequence
cagttccaaaccctggtggt

SEQ ID NO: 589 - DNA, 20 bp, Artificial Sequence
  Description of artificial sequence: synthetic oligonucleotide sequence
cggccagttccaaaccctgg

SEQ ID NO: 590 - DNA, 20 bp, Artificial Sequence
  Description of artificial sequence: synthetic oligonucleotide sequence
ggacccagactagcagcacc

SEQ ID NO: 591 - DNA, 20 bp, Artificial Sequence
  Description of artificial sequence: synthetic oligonucleotide sequence
gacgttacctcgtgcggccc

SEQ ID NO: 592 - DNA, 20 bp, Artificial Sequence
  Description of artificial sequence: synthetic oligonucleotide sequence
tccctgcagagaaacacact

SEQ ID NO: 593 - DNA, 20 bp, Artificial Sequence
  Description of artificial sequence: synthetic oligonucleotide sequence
gagactcaccaggggctggc

SEQ ID NO: 594 - DNA, 20 bp, Artificial Sequence
  Description of artificial sequence: synthetic oligonucleotide sequence
cctccttctttgaggagaaa

SEQ ID NO: 595 - DNA, 20 bp, Artificial Sequence
  Description of artificial sequence: synthetic oligonucleotide sequence
ggggttccagggcctgtctg

SEQ ID NO: 596 - DNA, 20 bp, Artificial Sequence
  Description of artificial sequence: synthetic oligonucleotide sequence
ttctctctggaagggcacaa

SEQ ID NO: 597 - DNA, 20 bp, Artificial Sequence
  Description of artificial sequence: synthetic oligonucleotide sequence
ccagtggcgagagaagaccc

SEQ ID NO: 598 - DNA, 20 bp, Artificial Sequence
  Description of artificial sequence: synthetic oligonucleotide sequence
tgcccagccactgaggcctg

SEQ ID NO: 599 - DNA, 20 bp, Artificial Sequence
  Description of artificial sequence: synthetic oligonucleotide sequence
cgactggccagggcgcctgt

SEQ ID NO: 600 - DNA, 20 bp, Artificial Sequence
  Description of artificial sequence: synthetic oligonucleotide sequence
accgcccagacgactggcca

SEQ ID NO: 601 - DNA, 20 bp, Artificial Sequence
  Description of artificial sequence: synthetic oligonucleotide sequence
tggagtacctgaggaatatc

SEQ ID NO: 602 - DNA, 20 bp, Artificial Sequence
  Description of artificial sequence: synthetic oligonucleotide sequence
ttaccccacttaactatctt

SEQ ID NO: 603 - DNA, 20 bp, Artificial Sequence
  Description of artificial sequence: synthetic oligonucleotide sequence
tcgatctatgaaaaagacag

SEQ ID NO: 604 - DNA, 18 bp, Artificial Sequence
  Description of artificial sequence: synthetic oligonucleotide sequence
taccccacttaactatct

SEQ ID NO: 605 - DNA, 20 bp, Artificial Sequence
  Description of artificial sequence: synthetic oligonucleotide sequence
ctcaggtactccaaagattc

SEQ ID NO: 606 - DNA, 20 bp, Artificial Sequence
  Description of artificial sequence: synthetic oligonucleotide sequence
cttaccccacttaactatct

SEQ ID NO: 607 - DNA, 20 bp, Artificial Sequence
  Description of artificial sequence: synthetic oligonucleotide sequence
ttttaccttggggctctgac

SEQ ID NO: 608 - DNA, 20 bp, Artificial Sequence
  Description of artificial sequence: synthetic oligonucleotide sequence
agccccaaggtaaaaaggcc

SEQ ID NO: 609 - DNA, 20 bp, Artificial Sequence
  Description of artificial sequence: synthetic oligonucleotide sequence
gagccccaaggtaaaaaggc

SEQ ID NO: 610 - DNA, 20 bp, Artificial Sequence
  Description of artificial sequence: synthetic oligonucleotide sequence
cagctcacagtgtgccacca

SEQ ID NO: 611 - DNA, 20 bp, Artificial Sequence
  Description of artificial sequence: synthetic oligonucleotide sequence
tatgaccagatggacctggc

SEQ ID NO: 612 - DNA, 20 bp, Artificial Sequence
  Description of artificial sequence: synthetic oligonucleotide sequence
actggaccagtatgtcttcc

SEQ ID NO: 613 - DNA, 20 bp, Artificial Sequence
  Description of artificial sequence: synthetic oligonucleotide sequence
tgtcttccaggactcccagc

SEQ ID NO: 614 - DNA, 20 bp, Artificial Sequence
  Description of artificial sequence: synthetic oligonucleotide sequence
ttcaaccaggagccagcctc

SEQ ID NO: 615 - DNA, 20 bp, Artificial Sequence
  Description of artificial sequence: synthetic oligonucleotide sequence
gaccagattcccagtatgtt

SEQ ID NO: 616 - DNA, 20 bp, Artificial Sequence
  Description of artificial sequence: synthetic oligonucleotide sequence
taacatactgggaatctggt

SEQ ID NO: 617 - DNA, 20 bp, Artificial Sequence
  Description of artificial sequence: synthetic oligonucleotide sequence
aaaggcactgcaagagacaa

SEQ ID NO: 618 - DNA, 20 bp, Artificial Sequence
  Description of artificial sequence: synthetic oligonucleotide sequence
ctctggcaaatctctgaggc

SEQ ID NO: 619 - DNA, 20 bp, Artificial Sequence
  Description of artificial sequence: synthetic oligonucleotide sequence
agccaagtaccccctcccag

SEQ ID NO: 620 - DNA, 20 bp, Artificial Sequence
  Description of artificial sequence: synthetic oligonucleotide sequence
acctcccgagcaaacatgac

SEQ ID NO: 621 - DNA, 20 bp, Artificial Sequence
  Description of artificial sequence: synthetic oligonucleotide sequence
ccttacctgtcatgtttgct

SEQ ID NO: 622 - DNA, 20 bp, Artificial Sequence
  Description of artificial sequence: synthetic oligonucleotide sequence
tgctctggagatggagaagc

SEQ ID NO: 623 - DNA, 20 bp, Artificial Sequence
  Description of artificial sequence: synthetic oligonucleotide sequence
cccacccaatgcccggcagc

SEQ ID NO: 624 - DNA, 20 bp, Artificial Sequence
  Description of artificial sequence: synthetic oligonucleotide sequence
aggccattttggaagcttgt

SEQ ID NO: 625 - DNA, 20 bp, Artificial Sequence
  Description of artificial sequence: synthetic oligonucleotide sequence
accggctctgcaaaggccag

SEQ ID NO: 626 - DNA, 20 bp, Artificial Sequence
  Description of artificial sequence: synthetic oligonucleotide sequence
tggtgcaggccaggctggag

SEQ ID NO: 627 - DNA, 20 bp, Artificial Sequence
  Description of artificial sequence: synthetic oligonucleotide sequence
gaacggcagctggcccaagg

SEQ ID NO: 628 - DNA, 20 bp, Artificial Sequence
  Description of artificial sequence: synthetic oligonucleotide sequence
ggcccaaggaggcctggctg

SEQ ID NO: 629 - DNA, 20 bp, Artificial Sequence
  Description of artificial sequence: synthetic oligonucleotide sequence
gacacgagtgattgctgtgc

SEQ ID NO: 630 - DNA, 20 bp, Artificial Sequence
  Description of artificial sequence: synthetic oligonucleotide sequence
ctggtcagggcaagagctat

SEQ ID NO: 631 - DNA, 20 bp, Artificial Sequence
  Description of artificial sequence: synthetic oligonucleotide sequence
gggcccacagccactcgtgg

SEQ ID NO: 632 - DNA, 20 bp, Artificial Sequence
  Description of artificial sequence: synthetic oligonucleotide sequence
ttccagaagaagctgctccg

SEQ ID NO: 633 - DNA, 20 bp, Artificial Sequence
  Description of artificial sequence: synthetic oligonucleotide sequence
cctggtccagagcctgagca

SEQ ID NO: 634 - DNA, 20 bp, Artificial Sequence
  Description of artificial sequence: synthetic oligonucleotide sequence
cagacatcaaagtaccctac

SEQ ID NO: 635 - DNA, 20 bp, Artificial Sequence
  Description of artificial sequence: synthetic oligonucleotide sequence
acatcaaagtaccctacagg

SEQ ID NO: 636 - DNA, 20 bp, Artificial Sequence
  Description of artificial sequence: synthetic oligonucleotide sequence
cgcccaggtcctcacgtctg

SEQ ID NO: 637 - DNA, 20 bp, Artificial Sequence
  Description of artificial sequence: synthetic oligonucleotide sequence
cttagtccaacacccaccgc

SEQ ID NO: 638 - DNA, 20 bp, Artificial Sequence
  Description of artificial sequence: synthetic oligonucleotide sequence
cctcctgcaatgcttcctgg

SEQ ID NO: 639 - DNA, 20 bp, Artificial Sequence
  Description of artificial sequence: synthetic oligonucleotide sequence
gagccagccacagggccccc

SEQ ID NO: 640 - DNA, 20 bp, Artificial Sequence
  Description of artificial sequence: synthetic oligonucleotide sequence
ggaagcagaaggtgcttgcg

SEQ ID NO: 641 - DNA, 20 bp, Artificial Sequence
  Description of artificial sequence: synthetic oligonucleotide sequence
ggctgcagccggggacactg

SEQ ID NO: 642 - DNA, 20 bp, Artificial Sequence
  Description of artificial sequence: synthetic oligonucleotide sequence
ctgccaaattccagcctcct

SEQ ID NO: 643 - DNA, 20 bp, Artificial Sequence
  Description of artificial sequence: synthetic oligonucleotide sequence
ggcgggccaagacttctccc

SEQ ID NO: 644 - DNA, 20 bp, Artificial Sequence
  Description of artificial sequence: synthetic oligonucleotide sequence
agactcagaggtgagaggag

SEQ ID NO: 645 - DNA, 20 bp, Artificial Sequence
  Description of artificial sequence: synthetic oligonucleotide sequence
agcctaggaggcaaagagca

SEQ ID NO: 646 - DNA, 20 bp, Artificial Sequence
  Description of artificial sequence: synthetic oligonucleotide sequence
cccccaggctttccccaaac

SEQ ID NO: 647 - DNA, 20 bp, Artificial Sequence
  Description of artificial sequence: synthetic oligonucleotide sequence
tcactccagatgctgcaggg

SEQ ID NO: 648 - DNA, 20 bp, Artificial Sequence
  Description of artificial sequence: synthetic oligonucleotide sequence
aggctgcaggtggaatcaga

SEQ ID NO: 649 - DNA, 20 bp, Artificial Sequence
  Description of artificial sequence: synthetic oligonucleotide sequence
cttcccccagctgaagtcct

SEQ ID NO: 650 - DNA, 20 bp, Artificial Sequence
  Description of artificial sequence: synthetic oligonucleotide sequence
cactcacttgagggtttcca

SEQ ID NO: 651 - DNA, 20 bp, Artificial Sequence
  Description of artificial sequence: synthetic oligonucleotide sequence
cagactgcggggacacagtg

SEQ ID NO: 652 - DNA, 20 bp, Artificial Sequence
  Description of artificial sequence: synthetic oligonucleotide sequence
ccactcaccttagcctgagc

SEQ ID NO: 653 - DNA, 20 bp, Artificial Sequence
  Description of artificial sequence: synthetic oligonucleotide sequence
cactcaccttagcctgagca

SEQ ID NO: 654 - DNA, 20 bp, Artificial Sequence
  Description of artificial sequence: synthetic oligonucleotide sequence
gtacaagctgtcggaaacag

SEQ ID NO: 655 - DNA, 20 bp, Artificial Sequence
  Description of artificial sequence: synthetic oligonucleotide sequence
acactcactccatcacccgg

SEQ ID NO: 656 - DNA, 20 bp, Artificial Sequence
  Description of artificial sequence: synthetic oligonucleotide sequence
cactcactccatcacccgga

SEQ ID NO: 657 - DNA, 20 bp, Artificial Sequence
  Description of artificial sequence: synthetic oligonucleotide sequence
cgtccagtacaacaagttca

SEQ ID NO: 658 - DNA, 20 bp, Artificial Sequence
  Description of artificial sequence: synthetic oligonucleotide sequence
ccacatcctgcaagggggga

SEQ ID NO: 659 - DNA, 20 bp, Artificial Sequence
  Description of artificial sequence: synthetic oligonucleotide sequence
cacatcctgcaaggggggat

SEQ ID NO: 660 - DNA, 20 bp, Artificial Sequence
  Description of artificial sequence: synthetic oligonucleotide sequence
tgggcgtccacatcctgcaa

SEQ ID NO: 661 - DNA, 20 bp, Artificial Sequence
  Description of artificial sequence: synthetic oligonucleotide sequence
gggcgtccacatcctgcaag

SEQ ID NO: 662 - DNA, 20 bp, Artificial Sequence
  Description of artificial sequence: synthetic oligonucleotide sequence
ggcgtccacatcctgcaagg

SEQ ID NO: 663 - DNA, 20 bp, Artificial Sequence
  Description of artificial sequence: synthetic oligonucleotide sequence
gcgtccacatcctgcaaggg

SEQ ID NO: 664 - DNA, 20 bp, Artificial Sequence
  Description of artificial sequence: synthetic oligonucleotide sequence
gcccaaggtaagagcttccc

SEQ ID NO: 665 - DNA, 20 bp, Artificial Sequence
  Description of artificial sequence: synthetic oligonucleotide sequence
gctcttaccttgggcagcca

SEQ ID NO: 666 - DNA, 20 bp, Artificial Sequence
  Description of artificial sequence: synthetic oligonucleotide sequence
agctcttaccttgggcagcc

SEQ ID NO: 667 - DNA, 20 bp, Artificial Sequence
  Description of artificial sequence: synthetic oligonucleotide sequence
tgcacctctggggaggacct

SEQ ID NO: 668 - DNA, 20 bp, Artificial Sequence
  Description of artificial sequence: synthetic oligonucleotide sequence
ctgcacctctggggaggacc

SEQ ID NO: 669 - DNA, 20 bp, Artificial Sequence
  Description of artificial sequence: synthetic oligonucleotide sequence
cgcctgcagctgtcggacac

SEQ ID NO: 670 - DNA, 20 bp, Artificial Sequence
  Description of artificial sequence: synthetic oligonucleotide sequence
cacctgccaggccatcacgg

SEQ ID NO: 671 - DNA, 20 bp, Artificial Sequence
  Description of artificial sequence: synthetic oligonucleotide sequence
ccctacctgtcaccaggacc

SEQ ID NO: 672 - DNA, 20 bp, Artificial Sequence
  Description of artificial sequence: synthetic oligonucleotide sequence
cctacctgtcaccaggacca

SEQ ID NO: 673 - DNA, 20 bp, Artificial Sequence
  Description of artificial sequence: synthetic oligonucleotide sequence
cctctgagaaggaaaaaaga

SEQ ID NO: 674 - DNA, 20 bp, Artificial Sequence
  Description of artificial sequence: synthetic oligonucleotide sequence
cagaggaacagtcccaagga

SEQ ID NO: 675 - DNA, 20 bp, Artificial Sequence
  Description of artificial sequence: synthetic oligonucleotide sequence
gtacaggtaagagcaacgcc

SEQ ID NO: 676 - DNA, 20 bp, Artificial Sequence
  Description of artificial sequence: synthetic oligonucleotide sequence
ctcttacctgtaccataacc

SEQ ID NO: 677 - DNA, 20 bp, Artificial Sequence
  Description of artificial sequence: synthetic oligonucleotide sequence
ttacctgtaccataaccagg

SEQ ID NO: 678 - DNA, 20 bp, Artificial Sequence
  Description of artificial sequence: synthetic oligonucleotide sequence
tgtatctgtaggaggagaag

SEQ ID NO: 679 - DNA, 20 bp, Artificial Sequence
  Description of artificial sequence: synthetic oligonucleotide sequence
gtatctgtaggaggagaagt

SEQ ID NO: 680 - DNA, 20 bp, Artificial Sequence
  Description of artificial sequence: synthetic oligonucleotide sequence
cagatacaaactggactctc

SEQ ID NO: 681 - DNA, 20 bp, Artificial Sequence
  Description of artificial sequence: synthetic oligonucleotide sequence
tctcaaaaccaaagatctcc

SEQ ID NO: 682 - DNA, 20 bp, Artificial Sequence
  Description of artificial sequence: synthetic oligonucleotide sequence
caacacaaccctgacctgtg

SEQ ID NO: 683 - DNA, 20 bp, Artificial Sequence
  Description of artificial sequence: synthetic oligonucleotide sequence
tcaccaaaaggaaaaaacag

SEQ ID NO: 684 - DNA, 20 bp, Artificial Sequence
  Description of artificial sequence: synthetic oligonucleotide sequence
ccacagtctgaaagaaagca

SEQ ID NO: 685 - DNA, 20 bp, Artificial Sequence
  Description of artificial sequence: synthetic oligonucleotide sequence
gacactgttggcacggagga

SEQ ID NO: 686 - DNA, 20 bp, Artificial Sequence
  Description of artificial sequence: synthetic oligonucleotide sequence
ttaccatggccatcaacaca

SEQ ID NO: 687 - DNA, 20 bp, Artificial Sequence
  Description of artificial sequence: synthetic oligonucleotide sequence
ccacagtctgaaagaaaaca

SEQ ID NO: 688 - DNA, 20 bp, Artificial Sequence
  Description of artificial sequence: synthetic oligonucleotide sequence
cacagtctgaaagaaaacag

SEQ ID NO: 689 - DNA, 20 bp, Artificial Sequence
  Description of artificial sequence: synthetic oligonucleotide sequence
ttaccatggccatcagcacg

SEQ ID NO: 690 - DNA, 20 bp, Artificial Sequence
  Description of artificial sequence: synthetic oligonucleotide sequence
gggtcataccagctgagccg

SEQ ID NO: 691 - DNA, 20 bp, Artificial Sequence
  Description of artificial sequence: synthetic oligonucleotide sequence
tggaaatctgggggtcagaa

SEQ ID NO: 692 - DNA, 20 bp, Artificial Sequence
  Description of artificial sequence: synthetic oligonucleotide sequence
gttacccacctaagcaggtc

SEQ ID NO: 693 - DNA, 20 bp, Artificial Sequence
  Description of artificial sequence: synthetic oligonucleotide sequence
tctgccagcggctgaactgt

SEQ ID NO: 694 - DNA, 20 bp, Artificial Sequence
  Description of artificial sequence: synthetic oligonucleotide sequence
ctgccagcggctgaactgtg

SEQ ID NO: 695 - DNA, 20 bp, Artificial Sequence
  Description of artificial sequence: synthetic oligonucleotide sequence
cctcccactgcttggagctc

SEQ ID NO: 696 - DNA, 20 bp, Artificial Sequence
  Description of artificial sequence: synthetic oligonucleotide sequence
gaagtgccagggccagctgg

SEQ ID NO: 697 - DNA, 20 bp, Artificial Sequence
  Description of artificial sequence: synthetic oligonucleotide sequence
ccatgtgccatccgtccttg

SEQ ID NO: 698 - DNA, 20 bp, Artificial Sequence
  Description of artificial sequence: synthetic oligonucleotide sequence
tttgcagccagagctggggc

SEQ ID NO: 699 - DNA, 20 bp, Artificial Sequence
  Description of artificial sequence: synthetic oligonucleotide sequence
ggttctgcaatgagacactc

SEQ ID NO: 700 - DNA, 20 bp, Artificial Sequence
  Description of artificial sequence: synthetic oligonucleotide sequence
ctccagagcccacaggtaag

SEQ ID NO: 701 - DNA, 20 bp, Artificial Sequence
  Description of artificial sequence: synthetic oligonucleotide sequence
accacaactccagagcccac

SEQ ID NO: 702 - DNA, 20 bp, Artificial Sequence
  Description of artificial sequence: synthetic oligonucleotide sequence
gagctaggagaggagagagc

SEQ ID NO: 703 - DNA, 20 bp, Artificial Sequence
  Description of artificial sequence: synthetic oligonucleotide sequence
ctcacttacctgagcaaagg

SEQ ID NO: 704 - DNA, 20 bp, Artificial Sequence
  Description of artificial sequence: synthetic oligonucleotide sequence
ctgcagctggtggcacagtc

SEQ ID NO: 705 - DNA, 20 bp, Artificial Sequence
  Description of artificial sequence: synthetic oligonucleotide sequence
gatcttccattggattggca

SEQ ID NO: 706 - DNA, 20 bp, Artificial Sequence
  Description of artificial sequence: synthetic oligonucleotide sequence
tgaggcccaggacaagaccc

SEQ ID NO: 707 - DNA, 20 bp, Artificial Sequence
  Description of artificial sequence: synthetic oligonucleotide sequence
aaacctgagaggggaagcaa

SEQ ID NO: 708 - DNA, 20 bp, Artificial Sequence
  Description of artificial sequence: synthetic oligonucleotide sequence
ctcccaccgcagcgagctcc

SEQ ID NO: 709 - DNA, 20 bp, Artificial Sequence
  Description of artificial sequence: synthetic oligonucleotide sequence
tttccagcccaaggtgcaga

SEQ ID NO: 710 - DNA, 20 bp, Artificial Sequence
  Description of artificial sequence: synthetic oligonucleotide sequence
ggtgcagagccgtctggtgg

SEQ ID NO: 711 - DNA, 20 bp, Artificial Sequence
  Description of artificial sequence: synthetic oligonucleotide sequence
aggtgcagagccgtctggtg

SEQ ID NO: 712 - DNA, 20 bp, Artificial Sequence
  Description of artificial sequence: synthetic oligonucleotide sequence
tcctatcgagtgctggacgc

SEQ ID NO: 713 - DNA, 20 bp, Artificial Sequence
  Description of artificial sequence: synthetic oligonucleotide sequence
aaggtgcagagccgtctggt

SEQ ID NO: 714 - DNA, 20 bp, Artificial Sequence
  Description of artificial sequence: synthetic oligonucleotide sequence
caaggtgcagagccgtctgg

SEQ ID NO: 715 - DNA, 20 bp, Artificial Sequence
  Description of artificial sequence: synthetic oligonucleotide sequence
gggctgcccactgagccccc

SEQ ID NO: 716 - DNA, 20 bp, Artificial Sequence
  Description of artificial sequence: synthetic oligonucleotide sequence
aggtgcgccagggggctcag

SEQ ID NO: 717 - DNA, 20 bp, Artificial Sequence
  Description of artificial sequence: synthetic oligonucleotide sequence
ggccaggatccaaaccccgc

SEQ ID NO: 718 - DNA, 20 bp, Artificial Sequence
  Description of artificial sequence: synthetic oligonucleotide sequence
cgccagtggattggcccaac

SEQ ID NO: 719 - DNA, 20 bp, Artificial Sequence
  Description of artificial sequence: synthetic oligonucleotide sequence
gcgccagtggattggcccaa

SEQ ID NO: 720 - DNA, 20 bp, Artificial Sequence
  Description of artificial sequence: synthetic oligonucleotide sequence
aagaagcagcgccagtggat

SEQ ID NO: 721 - DNA, 20 bp, Artificial Sequence
  Description of artificial sequence: synthetic oligonucleotide sequence
gcttacctggataagctgac

SEQ ID NO: 722 - DNA, 20 bp, Artificial Sequence
  Description of artificial sequence: synthetic oligonucleotide sequence
aaagacactgggcagatggt

SEQ ID NO: 723 - DNA, 20 bp, Artificial Sequence
  Description of artificial sequence: synthetic oligonucleotide sequence
ttccagagctggggaaagaa

SEQ ID NO: 724 - DNA, 20 bp, Artificial Sequence
  Description of artificial sequence: synthetic oligonucleotide sequence
actcacccagcatccccagc

SEQ ID NO: 725 - DNA, 20 bp, Artificial Sequence
  Description of artificial sequence: synthetic oligonucleotide sequence
agcgactgcagaaagaagag

SEQ ID NO: 726 - DNA, 20 bp, Artificial Sequence
  Description of artificial sequence: synthetic oligonucleotide sequence
cataccagctgagccgtccg

SEQ ID NO: 727 - DNA, 20 bp, Artificial Sequence
  Description of artificial sequence: synthetic oligonucleotide sequence
cctgcagagaaacacacttg

SEQ ID NO: 728 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 729 - DNA, 9199 bp, Homo sapiens
catgtcataaatggtaagtccaagaaaaatacaggtattcccccccaaagaaaactgtaaaatcgacttttttctatctgtactgttttttattggtttttaaattggttttccaagtgagtaaatcagaatctatctgtaatggattttaaatttagtgtttctctgtgatgtagtaaacaagaaactagaggcaaaaatagccctgtcccttgctaaacttctaaggcacttttctagtacaactcaacactaacatttcaggcctttagtgccttatatgagtttttaaaagggggaaaagggagggagcaagagtgtcttaactcatacatttaggcataacaattattctcatattttagttattgagagggctggtagaaaaactaggtaaataatattaataattatagcgcttattaaacactacagaacacttactatgtaccaggcattgtgggaggctctctcttgtgcattatctcatttcattaggtccatggagagtattgcattttcttagtttaggcatggcctccacaataaagattatcaaaagcctaaaaatatgtaaaagaaacctagaagttatttgttgtgctccttggggaagctaggcaaatcctttcaactgaaaaccatggtgacttccaagatctctgcccctccccatcgccatggtccacttcctcttctcactgttcctcttagaaaagatctgtggactccaccaccacgaaatggcggcaccttatttatggtcactttagagggtaggttttcttaatgggtctgcctgtcatgtttaacgtccttggctgggtccaaggcagatgcagtccaaactctcactaaaattgccgagccctttgtcttccagtgtctaaaatattaatgtcaatggaatcaggccagagtttgaattctagtctcttagcctttgtttcccctgtccataaaatgaatgggggtaattctttcctcctacagtttatttatatattcactaattcattcattcatccatccattcgttcattcggtttactgagtacctactatgtgccagcccctgttctagggtggaaactaagagaatgatgtacctagagggcgctggaagctctaaagccctagcagttactgcttttactattagtggtcgtttttttctcccccccgccccccgacaaatcaacagaacaaagaaaattacctaaacagcaaggacatagggaggaacttcttggcacagaactttccaaacactttttcctgaagggatacaagaagcaagaaaggtactctttcactaggaccttctctgagctgtcctcaggatgcttttgggactatttttcttacccagagaatggagaaaccctgcagggaattcccaagctgtagttataaacagaagttctccttctgctaggtagcattcaaagatcttaatcttctgggtttccgttttctcgaatgaaaaatgcaggtccgagcagttaactggctggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaa

SEQ ID NO: 730 - protein, 1131 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFIEHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 731 - DNA, 4657 bp, Homo sapiens
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcatagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 732 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 733 - DNA, 748 bp, Homo sapiens
gacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgagg

SEQ ID NO: 734 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 735 - DNA, 1565 bp, Homo sapiens
agtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 736 - protein, 438 aa, Homo sapiens
MVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 737 - DNA, 3376 bp, Homo sapiens
gagtcttgctgatgctcccggctgaataaaccccttccttctttaacttggtgtctgaggggttttgtctgtggcttgtcctgctacatttcttggttccctgaccaggaagcaaagtgattaacggacagttgaggcagccccttaggcagcttaggcctgccttgtggagcatccccgcggggaactctggccagcttgagcgacacggatcctcagagcgctcccaggtaggcaattgccccagtggaatgcctcgtcagagcagtgcatggcaggcccctgtggaggatcaacgcagtggctgaacacagggaaggaactggcacttggagtccggacaactgaaacttgtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccacctgtcagcttatccagctctggaaggggctctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaaaaaaaaaaaaaaaaaaaaaaaa

SEQ ID NO: 738 - protein, 240 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 739 - DNA, 1284 bp, Homo sapiens
ctctctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttcc

SEQ ID NO: 740 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 741 - DNA, 5872 bp, Homo sapiens
gcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatgataggtatgaagtacagtgagaaaattaacacctgtgagctcattgtcctaccacagcactagagtgggggccgccaaactcccatggccaaacctggtgcaccatttgcctttgtttgtctgttggtttgcttgagacagtcttgctctgttgcccaggctggaatggagtggctattcacaggcacaatcatagcacactttagccttaaactcctgggctcaagtgatccacccgcctcagtctcccaagtagctgggattacaggtgcaaacctggcatgcctgccattgtttggcttatgatctaaggatagctttttaaattttattcattttatttttttttgagacagtgtctcactctgtctcccaggctggagtacagtggtacaatcttggatcaccgcctcccagtttcaagtgatctccctgcctcagcctcctaagtagctgggactacaggtatgtgccaccacgcctggctaatttttatatttttagtagagacggggtttcaccatgttgtccaggctggtctcaaactcctgacctcaggtgatctgcccacctctgcctcccaaagtgctgggattacaggcatgagccaccatgcctggccatttcttacacttttgtatgacatgcctattgcaagcttgcgtgcctctgtcccatgttattttactctgggatttaggtggagggagcagcttctatttggaacattggccatcgcatggcaaatgggtatctgtcacttctgctcctatttagttggttctactataacctttagagcaaatcctgcagccaagccaggcatcaatagggcagaaaagtatattctgtaaataggggtgaggagaagatatttctgaacaatagtctactgcagtaccaaattgcttttcaaagtggctgttctaatgtactcccgtcagtcatataagtgtcatgtaagtatcccattgatccacatccttgctaccctctggtactatcaggtgcccttaattttgccaagccagtgggtatagaatgagatctcactgtggtcttagtttgcatttgcttggttactgatgagcaccttgtcaaatatttatataccatttgtgtttatttttttaaataaaatgcttgctcatgcttttttgcccatttgcaaaaaaacttggggccgggtgcagtggctcatgcctgtagtcccagctctttgggaggccaaggtgggcagatcgcttgagcccaggagttcgagaccagccttggcaacatggcgaaaccctgtctttacaaaaaatacaaaaattagccgggtgtggtggtgtgcacctgaagtcccagctactcagtaggttcgctttgagcctgggaggcagaggttgcagtgagctgggaccgcatcactacacttcagcctgggcaacagagaaaaaccttttctcagaaacaaacaaacccaaatgtggttgtttgtcctgattcctaaaaggtctttatgtattctagataataatctttggtcagttatatgtgttaaaaaatatcttctttgtggccaggcacggtagctcacacctgtaatcccagcactttgcggggctgaggtgggtggatcatctgaggtcaagagttcaagatcagcctggccaacacagtgaaaccccatctctactaaacatgtacaaaacttagctgggtatggtggcgggtgcctgtaaccccagctgctccagaggctgtggcagaagaatcgcttgaacccaggaggcagaggttgcagcgagccaagattgtgccattgcactccagactgggtgacaagagtgaaattctgcctatctatctatctatctatctatatctatatatatatatatatatatcctttgtaatttatttttccctttttaaaattttttataaaattcttttttatttttatttttagcagaggtgaggtttctgaggtttcattatgttgcccaggctggtcttgaactcctgagctcaagtgatcctcccacctcagccttccaaagtgctggaattgcagacatgagccaccgcgcccctcctgtttttctctaattaatggtgtctttctttgtctttctggtaataagcaaaaagttcttcatttgatttggttaaatttataactgttttctcatatggttaacattttttcttgcctggctaaagaaatccttttctgcccaatactataaagaggtttgcccacattttattccaaaagttttaagttttgtctttcatcttgaagtctaatgtatcaggaactggcttttgtgcctgttgggaggtagtgatccaattccatgtcttgcatgtaggtaaccactggtccctgcgccatgtattcaatacgtcgtctttctcctgcgggtctgcaatctcacctaccatccatcaagtttccatagggccatgggtctgcttctgggctccctgttctgttccattgtcaatttgtctatcctgtgccagtatcacactgtgtttattacaatagctttgtaacagctctcgatatccggtaggacatctccctccaccttctttttctacttcagaagtgtcttagctaggtcaggcacggtggctcacgcctgtaatcccagcactttgggaggccgacgcggatggatcacctgaggtcaggagttttgagacagcctggccaacatggtgaaaccccatctctactaaaaaatacaaaaattagtcaggcatggtggcatgtgcctgtaatcccagctatttgggaggctgaggccggagaattgcttgaacccggggggcggaggttgcagtgagccgagatcgtaccattgcactccagcctgggtgacagagcgaaactctgtctcaggaaaaaaaagaaaagagatgtcttggttattcttggttctttattattcaatataaattttagaagctgaatttgaaaagatttggattggaatttcattaaatctacaggtcaatttagggagagttgataattttacagaattgagtcatctggtgttccaataagaataagagaacaattattggctgtacaattcttgccaaatagtaggcaaagcaaagcttaggaagtatactggtgccatttcaggaacaaagctaggtgcgaatatttttgtctttctgaatcatgatgctgtaagttctaaagtgatttctcctcttggctttggacacatggtgtttaattacctactgctgactatccacaaacagaaagagactggtcatgccccacagggttggggtatccaagataatggagcgaggctctcatgtgtcctaggttacacaccgaaaatccacagtttattctgtgaagaaaggaggctatgtttatgatacagactgtgatatttttatcatagcctattctggtatcatgtgcaaaagctataaatgaaaaacacaggaacttggcatgtgagtcattgctccccctaaatgacaattaataaggaaggaacattgagacagaataaaatgatccccttctgggtttaatttagaaagttccataattaggtttaatagaaataaatgtaaatttctatgattaaaaataaattagcacatttagggatacacaaattataaatcattttctaaatgctaaaaacaagctcaggtttttttcagaagaaagttttaattttttttctttagtggaagatatcactctgacggaaagttttgatgtgaggggcggatgactataaagtgggcatcttcccccacaggaagatgtttccatctgtgggtgagaggtgcccaccgcagctagggcaggttacatgtgccctgtgtgtggtaggacttggagagtgatctttatcaacgtttttatttaaaagactatctaataaaacacaaaactatgatgttcacaggaaaaaaagaataagaaaaaaaga

SEQ ID NO: 742 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 743 - DNA, 1600 bp, Homo sapiens
aaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctactctgctttttttctactgttttaatttatactggcatgctaaagccttcctattttgcataataaatgcttcagtgaaaatgca

SEQ ID NO: 744 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 745 - DNA, 867 bp, Homo sapiens
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctga

SEQ ID NO: 746 - protein, 140 aa, Homo sapiens
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 747 - DNA, 5651 bp, Homo sapiens
catgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaaggacgccagaaagctgttgatcggcttcaagcaggggagggacacctaatttgcttttcttttttttttttttttttttttttttttttgagatggagttttgctcttgttgcccaggctggagtgcaatggtgcatcttggctcactgcaacctccgcctcccaggttcaagtgattctcctgcctcagcctcccgagtagctgagattacaggcacccgccaccatgcctggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccatctctgactttccattctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcgtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattaaccaggtgtggtgctgcacacctgtagtcccagctacttaagaggctgagatgggaggatcgcttgagccctggaatgttgaggctacaatgagctgtgattgcgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttcattaaaatgatttggaagagcaga

SEQ ID NO: 748 - DNA, 1508 bp, Homo sapiens
ttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgatctcgaaccgaacagcagtgcttccaagataatctttggatcagggaccagactcagcatccggccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggtaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctggagaatgttgtgaggggtttatttttttttaatagtgttcataaagaaatacatagtattcttcttctcaagacgtggggggaaattatctcattatcgaggccctgctatgctgtgtgtctgggcgtgttgtatgtcctgctgccgatgccttcattaaaatgatttggaa

SEQ ID NO: 749 - protein, 176 aa, Homo sapiens
DLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 750 - DNA, 1151 bp, Homo sapiens
ctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttctcgacctgttcggctaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggttcaatacacattcttcttttgccagcgcttctgaagagctgctctcacctctctgcatcccaatagatatccccctatgtgcatgcacacctgcacactcacggctgaaatctccctaacccagggggac

SEQ ID NO: 751 - protein, 178 aa, Homo sapiens
DLKNVFPPKVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 752 - DNA, 1489 bp, Homo sapiens
aggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctag

SEQ ID NO: 753 - protein, 20 aa, Artificial Sequence
  Description of artificial sequence: synthetic peptide sequence
METDTLLLWVLLLWVPGSTG

SEQ ID NO: 754 - protein, 566 aa, Artificial Sequence
  Description of artificial sequence: synthetic polypeptide sequence
METDTLLLWVLLLWVPGSTGDVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELKGGGGSGGGGSGGGGSEVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSSSDPTTTPAPRPPTPAPTIASQPLSLRPEACRPAAGGAVHTRGLDFACDIYIWAPLAGTCGVLLLSLVITLYCTKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 755 - protein, 566 aa, Artificial Sequence
  Description of artificial sequence: synthetic polypeptide sequence
METDTLLLWVLLLWVPGSTGEVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSSGGGGSGGGGSGGGGSDVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELKSDPTTTPAPRPPTPAPTIASQPLSLRPEACRPAAGGAVHTRGLDFACDIYIWAPLAGTCGVLLLSLVITLYCTKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 756 - protein, 566 aa, Artificial Sequence
  Description of artificial sequence: synthetic polypeptide sequence
METDTLLLWVLLLWVPGSTGDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKGGGGSGGGGSGGGGSQVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSSSDPTTTPAPRPPTPAPTIASQPLSLRPEACRPAAGGAVHTRGLDFACDIYIWAPLAGTCGVLLLSLVITLYCTKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 757 - protein, 566 aa, Artificial Sequence
  Description of artificial sequence: synthetic polypeptide sequence
METDTLLLWVLLLWVPGSTGQVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSSGGGGSGGGGSGGGGSDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKSDPTTTPAPRPPTPAPTIASQPLSLRPEACRPAAGGAVHTRGLDFACDIYIWAPLAGTCGVLLLSLVITLYCTKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 758 - protein, 571 aa, Artificial Sequence
  Description of artificial sequence: synthetic polypeptide sequence
METDTLLLWVLLLWVPGSTGDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSSSDPTTTPAPRPPTPAPTIASQPLSLRPEACRPAAGGAVHTRGLDFACDIYIWAPLAGTCGVLLLSLVITLYCTKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 759 - protein, 571 aa, Artificial Sequence
  Description of artificial sequence: synthetic polypeptide sequence
METDTLLLWVLLLWVPGSTGQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSSGGGGSGGGGSGGGGSDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKSDPTTTPAPRPPTPAPTIASQPLSLRPEACRPAAGGAVHTRGLDFACDIYIWAPLAGTCGVLLLSLVITLYCTKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSNRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 760 - protein, 37 aa, Artificial Sequence
  Description of artificial sequence: synthetic polypeptide sequence
RRDQRLPPDAHKPPGGGSFRTPIQEEQADAHSTLAKI

SEQ ID NO: 761 - protein, 490 aa, Artificial Sequence
  Description of artificial sequence: synthetic polypeptide sequence
METDTLLLWVLLLWVPGSTGDVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELKGGGGSGGGGSGGGGSEVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSSSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 762 - protein, 490 aa, Artificial Sequence
  Description of artificial sequence: synthetic polypeptide sequence
METDTLLLWVLLLWVPGSTGEVQLQQSGPELQRPGASVKLSCKASGYIFTEYYMYWVKQRPKQQLELVGRIDPEDGSIDYVEKFKKKATLTADTSSNTAYMQLSSLTSEDTATYFCARGKFNYRFAYWGQGTLVTVSSGGGGSGGGGSGGGGSDVVLTQTPPTLLATIGQSVSISCRSSQSLLHSSGNTYLNWLLQRTGQSPQPLIYLVSKLESGVPNRFSGSGSGTDFTLKISGVEAEDLGVYYCMQFTHYPYTFGAGTKLELKSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 763 - protein, 490 aa, Artificial Sequence
  Description of artificial sequence: synthetic polypeptide sequence
METDTLLLWVLLLWVPGSTGDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKGGGGSGGGGSGGGGSQVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSSSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 764 - protein, 490 aa, Artificial Sequence
  Description of artificial sequence: synthetic polypeptide sequence
METDTLLLWVLLLWVPGSTGQVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSSGGGGSGGGGSGGGGSDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 765 - protein, 495 aa, Artificial Sequence
  Description of artificial sequence: synthetic polypeptide sequence
METDTLLLWVLLLWVPGSTGDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSSSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 766 - protein, 495 aa, Artificial Sequence
  Description of artificial sequence: synthetic polypeptide sequence
METDTLLLWVLLLWVPGSTGQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARGRTEYIVVAEGFDYWGQGTLVTVSSGGGGSGGGGSGGGGSDVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIKSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

What is claimed is:

1. A chimeric antigen receptor (CAR) comprising:

an anti-CD2 binding domain comprising an amino acid sequence selected from the group consisting of:

SEQ ID NO: 383; SEQ ID NO: 385; SEQ ID NO: 386; and SEQ ID NO: 387;

a transmembrane domain;

a CD2 signaling domain having at least 85% identity to an amino acid sequence selected from the group consisting of:

SEQ ID NO: 370; SEQ ID NO: 371; SEQ ID NO: 372; SEQ ID NO: 373; SEQ ID NO: 374; SEQ ID NO: 375; SEQ ID NO: 376; SEQ ID NO: 377; SEQ ID NO: 378; SEQ ID NO: 379; and SEQ ID NO: 380;

a leader peptide sequence; and one or more additional signaling domains, the one or more additional signaling domains selected from a CD3ζ signaling domain, a CD28 signaling domain, and a CD137 (4-1BB) signaling domain.

2. The CAR of claim 1, wherein the transmembrane domain is a CD8a transmembrane.

3. The CAR of claim 1, wherein the leader peptide sequence has at least 85%, at least 90%, at least 95%, at least 98%, at least 99%, or 100% identity to the amino acid sequence set forth in SEQ ID NO: 753.

4. The CAR of claim 1, wherein the CD2 signaling domain is at least 90% or 95% identical to the sequence of the CD2 signaling domain selected from the group consisting of SEQ ID NO: 370; SEQ ID NO: 371; SEQ ID NO: 372; SEQ ID NO: 373; SEQ ID NO: 374; SEQ ID NO: 375; SEQ ID NO: 376; SEQ ID NO: 377; SEQ ID NO: 378; SEQ ID NO: 379; and SEQ ID NO: 380.

5. A chimeric antigen receptor (CAR), wherein the CAR comprises any one of the following amino acid sequences:

SEQ ID NO: 755; SEQ ID NO: 757; SEQ ID NO: 758; SEQ ID NO: 759; SEQ ID NO: 762; SEQ ID NO: 764; SEQ ID NO: 765; and SEQ ID NO: 766.

6. A nucleic acid encoding the chimeric antigen receptor of claim 1.

7. An anti-CD2 binding domain comprising an amino acid sequence selected from the group consisting of:

SEQ ID NO: 383; SEQ ID NO: 385; SEQ ID NO: 386; and SEQ ID NO: 387.

8. A nucleic acid encoding the anti-CD2 binding domain of claim 7.

* * * * *